US009970059B2

(12) United States Patent
Rimsza et al.

(10) Patent No.: US 9,970,059 B2
(45) Date of Patent: May 15, 2018

(54) SURVIVAL PREDICTOR FOR DIFFUSE LARGE B CELL LYMPHOMA

(71) Applicants: The United States of America, as represented by the Secretary, Department of Health and Human Services, Washington, DC (US); Arizona Board of Regents on behalf of the University of Arizona, Tucson, AZ (US); Queen Mary University of London, London (GB); Board of Regents of the University of Nebraska, Lincoln, NE (US); Oslo University Hospital HF, Oslo (NO); Oregon Health & Science University, Portland, OR (US); University of Rochester, Rochester, NY (US); Hospital Clinic de Barcelona, Barcelona (ES); Universitat De Barcelona, Barcelona (ES); British Columbia Cancer Agency Branch, Vancouver (CA); Julius-Maximilians-University of Wuerzburg, Wuerzburg (DE)

(72) Inventors: Lisa Rimsza, Tucson, AZ (US); Andrew T. Lister, London (GB); Wing C. Chan, Omaha, NE (US); Dennis Weisenburger, Elkhorn, NE (US); Jan Delabie, Oslo (NO); Erlend B. Smeland, Oslo (NO); Harald Holte, Oslo (NO); Stein Kvaloy, Oslo (NO); Rita M. Braziel, West Linn, OR (US); Richard I. Fisher, Pittsford, NY (US); Pedro Jares, Barcelona (ES); Armando Lopez-Guillermo, Barcelona (ES); Elias Campo Guerri, Barcelona (ES); Elaine S. Jaffe, Great Falls, VA (US); Georg Lenz, Berlin (DE); Wyndham H. Wilson, Washington, DC (US); George Wright, Rockville, MD (US); Sandeep S. Dave, Chapel Hill, NC (US); Louis M. Staudt, Bethesda, MD (US); Randy D. Gascoyne, North Vancouver (CA); Joseph M. Connors, Vancouver (CA); Hans-Konrad Muller-Hermelink, Wrzburg (DE); Andreas Rosenwald, Wuerzburg (DE); German Ott, Bietigheim-Bissingen (DE)

(73) Assignees: The United States of America, as represented by the Secretary, Department of Human Services, Washington, DC (US); Arizona Board of Regents on behalf of the University of Arizona, Tucson, AZ (US); Queen Mary University of London, London (GB); Board of Regents of the University of Nebraska, Lincoln, NE (US); Oslo University Hospital HF, Oslo (NO); Oregon Health & Science University, Portland, OR (US); University of Rochester, Rochester, NY (US); Hospital Clinic de Barcelona, Barcelona (ES); Universitat de Barcelona, Barcelona (ES); British Columbia Cancer Agency Branch, Vancouver (CA); Julius-Maximilians-University of Würzburg, Würzburg (DE)

( * ) Notice: Subject to any disclaimer, the term of this patent is extended or adjusted under 35 U.S.C. 154(b) by 588 days.

(21) Appl. No.: 14/540,302

(22) Filed: Nov. 13, 2014

(65) Prior Publication Data

US 2015/0132297 A1    May 14, 2015

Related U.S. Application Data

(63) Continuation of application No. 12/996,489, filed as application No. PCT/US2009/046421 on Jun. 5, 2009, now abandoned.

(Continued)

(51) Int. Cl.
*C12Q 1/68* (2018.01)
*G01N 33/574* (2006.01)

(52) U.S. Cl.
CPC ..... *C12Q 1/6886* (2013.01); *G01N 33/57407* (2013.01); *C12Q 2600/106* (2013.01);
(Continued)

(58) Field of Classification Search
None
See application file for complete search history.

(56) References Cited

U.S. PATENT DOCUMENTS

| 5,445,934 A | 8/1995 | Fodor et al. |
| 5,744,305 A | 4/1998 | Fodor et al. |

(Continued)

FOREIGN PATENT DOCUMENTS

| WO | WO 02/24956 A2 | 3/2002 |
| WO | WO 03/021229 A2 | 3/2003 |

(Continued)

OTHER PUBLICATIONS

Ganjoo, "Antiangiogenesis: A new approach to the treatment of lymphoma," (Leukemia and Lymphoma, vol. 48 (2007) pp. 454-455).*

(Continued)

*Primary Examiner* — Anna Skibinsky
(74) *Attorney, Agent, or Firm* — Leydig, Voit & Mayer, Ltd.

(57) ABSTRACT

The invention provides methods and materials related to a gene expression-based survival predictor for DLBCL patients.

16 Claims, 22 Drawing Sheets

Related U.S. Application Data

(60) Provisional application No. 61/059,678, filed on Jun. 6, 2008.

(52) U.S. Cl.
CPC .... *C12Q 2600/112* (2013.01); *G01N 2800/52* (2013.01); *G01N 2800/56* (2013.01)

(56) References Cited

U.S. PATENT DOCUMENTS

| | | | |
|---|---|---|---|
| 6,020,198 | A | 2/2000 | Bennett et al. |
| 6,410,229 | B1 | 6/2002 | Lockhart et al. |
| 7,711,492 | B2 | 5/2010 | Staudt et al. |
| 2002/0110820 | A1 | 8/2002 | Ramaswamy et al. |
| 2003/0194701 | A1 | 10/2003 | Golub et al. |
| 2003/0219760 | A1 | 11/2003 | Gordon et al. |
| 2005/0164231 | A1 | 7/2005 | Staudt et al. |
| 2008/0051379 | A1* | 2/2008 | Lerner ............ A61K 31/56 514/171 |
| 2008/0138336 | A1* | 6/2008 | Damschroder .... C07K 16/2803 424/133.1 |
| 2009/0023149 | A1* | 1/2009 | Knudsen ............ C12Q 1/6886 435/6.14 |

FOREIGN PATENT DOCUMENTS

| WO | WO 03/024956 A1 | 3/2003 |
|---|---|---|
| WO | WO 2005/024043 A2 | 3/2005 |

OTHER PUBLICATIONS

U.S. Appl. No. 12/996,489, filed Feb. 24, 2011.
U.S. Appl. No. 60/500,537, filed Sep. 3, 2003, Staudt et al.
Alizadeh et al., "Distinct Types of Diffuse Large B-Cell Lymphoma Identified by Gene Expression Profiling," *Nature*, 403, 503-511 (2000).
Alon et al., "Broad Patterns of Gene Expression Revealed by Clustering Analysis of Tumor and Normal Colon Tissues Probed by Oligonucleotide Arrays," *Proc. Nat'l. Acad. Sci. USA*, 96, 6745-6750 (1999).
Andreasson et al., "Genomic Amplification of CCND2 is Rare in Non-Hodgkin Lymphomas," *Cancer Genet. Cytogenet.*, 102, 81-82 (1998).
Basso et al., "Tracking CD40 Signaling During Germinal Center Development," *Blood*, 104 (13), 4088-4096 (2004).
Bea et al., "Diffuse Large B-Cell Lymphoma Subgroups Have Distinct Genetic Profiles That Influence Tumor Biology and Improve Gene-Expression-Based Survival Prediction," *Blood*, 106 (9), 3183-3190 (2005).
Bea et al., "Increased Number of Chromosomal Imbalances and High-Level DNA Amplifications in Mantle Cell Lymphoma Are Associated With Blastoid Variants," *Blood*, 93 (12), 4365-4374 (1999).
Bea et al., "Clinicopathologic Significance and Prognostic Value of Chromosomal Imbalances in Diffuse Large B-Cell Lymphomas," *J. Clin. Oncol.*, 22 (17), 3498-3506 (2004).
Berglund et al., "Chromosomal Imbalances in Diffuse Large B-Cell Lymphoma Detected by Comparative Genomic Hybridization," *Mod. Pathol.*, 15 (8), 807-817 (2002).
Bergsagel et al., "Critical Roles for Immunoglobulin Translocations and Cyclin D Dysregulation in Multiple Myeloma," *Immunol. Rev.*, 194, 96-104 (2003).
Bishop et al., "Burkitt's Lymphoma: Molecular Pathogenesis and Treatment," *Cancer Invest.*, 18 (6), 574-583 (2000).
Boxer et al., "Translocations Involving c-myc and c-myc Function," Oncogene, 20, 5595-5610 (2001).
Chiarle et al., "Increased Proteasome Degradation of Cyclin-Dependent Kinase Inhibitor p27 is Associated with a Decreased Overall Survival in Mantle Cell Lymphoma," *Blood*, 95, 619-626 (2000).
Cho et al., "A Genome-Wide Transcriptional Analysis of the Mitotic Cell Cycle," *Mol. Cell.*, 2, 65-73 (1998).
Chu et al., "The Transcriptional Program of Sporulation in Budding Yeast," *Science*, 282, 699-705 (1998).
Cigudosa et al., "Cytogenetic Analysis of 363 Consecutively Ascertained Diffuse Large B-Cell Lymphomas," *Genes Chromosomes Cancer*, 25, 123-133 (1999).
Coiffier et al., "Chop Chemotherapy Plus Rituximab Compared with Chop Alone in Elderly Patients with Diffuse Large B-Cell Lymphoma," *N. Engl. J. Med.*, 346 (4), 235-242 (2002).
Dave et al., "Cytogentic Characterization of Diffuse Large Cell Lymphoma Using Multi-Color Fluorescence In Situ Hybridization," *Cancer Genet. Cytogenet.*, 132, 125-132 (2002).
Dave et al., "Molecular Diagnosis of Burkitt's Lymphoma," *N. England J. Med.*, 354 (23), 2431-2442 (2006).
Davis et al., "Molecular Diagnosis of Lymphoid Malignancies by Gene Expression Profiling," *Curr. Opin. Hematol.*, 9, 333-338 (2002).
Davis et al., "Constitutive Nuclear Factor kB Activity is Required for Survival of Activated B Cell-like Diffuse Large B Cell Lymphoma Cells," *J. Exp. Med.*, 194 (12),1861-1874 (2001).
Delmer et al., "Overexpression of Cyclin D2 Chronic B-Cell Malignancies," *Blood*, 85 (10), 2870-2876 (1995).
Derisi et al., "Exploring the Metabolic and Genetic Control of Gene Expression on a Genomic Scale," *Science*, 278, 680-686 (1997).
Doglioni et al., "Cyclin D2 Expression in Normal, Reactive and Neoplastic Tissues," *J. Pathol.*, 185, 159-166 (1998).
Eisen et al., "Cluster Analysis and Display of Genome-wide Expression Patterns," *Proc. Nat'l. Acad. Sci. USA*, 95, 14863-14868 (1998).
European Search Report, Application No. 09170243.1, dated Jun. 24, 2010.
Feuerhake et al., "NFκB Activity, Function, and Target-Gene Signatures in Primary Mediastinal Large B-cell Lymphoma and Diffuse Large B-cell Lymphoma Subtypes," *Blood*, 106 (4), 1392-1399 (2005).
Fu et al., "Cyclin D1-negative Mantle Cell Lymphoma: a Clinicopathologic Study Based on Gene Expression Profiling," *Blood*, 106 (13), 4315-4321 (2005).
Gerbitz et al., "Deregulation of the Proto-oncogene c-myc through t(8;22) Translocation in Burkitt's Lymphoma," *Oncogene*, 18, 1745-1753 (1999).
Goff et al., "The Use of Real-time Quantitative Polymerase Chain Reaction and Comparative Genomic Hybridization to Identify Amplification of the REL gene in Follicular Lymphoma," *Br. J. Haematol.*, 111, 618-625 (2000).
Gress et al., "A Pancreatic Cancer-specific Expression Profile," *Oncogene*, 13, 1819-1830 (1996).
Haralambieva et al., "Clinical, Immunophenotypic, and Genetic Analysis of Adult Lymphomas with Morphologic Features of Burkitt Lymphoma," *Am. J. Surg. Pathol.*, 29 (8), 1086-1094 (2005).
Holstege et al., "Dissecting the Regulatory Circuitry of a Eukaryotic Genome," *Cell.*, 95, 717-728 (1998).
Huang et al., "The t(14;18) Defines a Unique Subset of Diffuse Large B-cell Lymphoma with a Germinal Center B-cell Gene Expression Profile," *Blood*, 99, 2285-2290 (2002).
Hummel et al., "A Biologic Definition of Burkitt's Lymphoma from Transcriptional and Genomic Profiling," *N. Engl. J. Med.*, 354 (23), 2419-2430 (2006).
Hyman et al., "Impact of DNA Amplification on Gene Expression Patterns in Breast Cancer," *Cancer Res.*, 62, 6240-6245 (2002).
Iqbal et al., "BCL2 Translocation Defines a Unique Tumor Subset within the Germinal Center B-Cell-Like Diffuse Large B-Cell Lymphoma," *Am. J. Pathol.*, 165 (1), 159-166 (2004).
International Search Report, Application No. PCT/US2007/016843, dated Oct. 30, 2008.
International Search Report, Application No. PCT/US04/29041, dated Aug. 26, 2005.
Jares et al., "Expression of Retinoblastoma Gene Product (pRb) in Mantle Cell Lymphomas—Correlation with Cyclin D1 (PRAD1/CCND1) mRNA Levels and Proliferative Activity," *Am. J. Pathol.*, 148 (5), 1591-1600 (1996).

(56) References Cited

OTHER PUBLICATIONS

Kramer et al., "Clinical Relevance of BCL2, BCL6, and MYC Rearrangements in Diffuse Large B-Cell Lymphoma," *Blood*, 92 (9), 3152-3162 (1998).
Lenz et al., "Stromal Gene Signatures in Large-B-Cell Lymphomas," *N. Engl. J. Med.*, 359 (22), 2313-2323 (2008) (with supplementary material).
Lenz et al., "Oncogenic CARD11 Mutations in Human Diffuse Large B Cell Lymphoma," *Science*, 319, 1676-1679 (2008).
Li, "Survival Prediction of Diffuse Large B-cell Lymphoma Based on Both Clinical and Gene Expression Information," *Bioinformatics*, 22 (4), 466-471 (2006).
Mahadevan et al., "Transcript Profiling in Peripheral T-cell Lymphoma, not Otherwise Specified, and Diffuse Large B-cell Lymphoma Identifies Distinct Tumor Profile Signatures," *Mol. Cancer Ther.*, 4 (12), 1867-1879 (2005).
Monni et al., "DNA Copy Number Changes in Diffuse Large B-Cell Lymphoma—Comparative Genomic Hybridization Study," *Blood*, 87 (12), 5269-5278 (1996).
Monti et al., "Molecular Profiling of Diffuse Large B-cell Lymphoma Identifies Robust Subtypes Including One Characterized by Host Inflammatory Response," *Blood*, 105,1851-1861(2005).
Mounier et al., "Rituximab Plus CHOP (R-CHOP) Overcomes bcl-2-associated Resistance to Chemotherapy in Elderly Patients with Diffuse Large B-cell Lymphoma (DLBCL)," *Blood*, 101, 4279-4284 (2003).
Neri et al., "Different Regions of the Immunoglobulin Heavy-Chain Locus are Involved in Chromosomal Translocations in Distinct Pathogenetic Forms of Burkitt Lymphoma," *Proc. Natl. Acad. Sci. USA*, 85, 2748-2752 (1988).
Ngo et al., "A Loss-of-function RNA Interference Screen for Molecular Targets in Cancer," *Nature*, 441, 106-110 (2006).
Nyman et al., "Prognostic Impact of Immunohistochemically Defined Germinal Center Phenotype in Diffuse Large B-cell Lymphoma Patients Treated with Immunochemotherapy," *Blood*, 109, 4930-4935 (2007).
Orsetti et al., "Genomic and Expression Profiling of Chromosome 17 in Breast Cancer Reveals Complex Patterns of Alterations and Novel Candidate Genes," *Cancer Res.*, 64, 6453-6460 (2004).
Ott et al., "Cyclin D1 Expressions in Mantle Cell Lymphoma is Accompanied by Downregulation of Cyclin D3 and is not Related to the Proliferative Activity," *Blood*, 90 (8), 3154-3159 (1997).
Pruneri et al., "Immunoreactivity for Cyclin D3 is Frequently Detectable in High-grade Primary Gastric Lymphomas in the Absence of the t(6;14)(p21.1;q32.3) Chromosomal Translocation," *J. Pathol.*, 200, 596-601 (2003).
Quintanilla-Martinez et al., "Mantle Cell Lymphomas Lack Expression of $p27^{klp1}$, a Cyclin-Dependent Kinase Inhibitor," *Am. J. Pathol.*, 153 (1), 175-182 (1998).
Ransohoff, "Rules of Evidence for Cancer Molecular-Marker Discovery and Validation," *Nat. Rev. Cancer*, 4, 309-314 (2004).
Rao et al., "Chromosomal and Gene Amplification in Diffuse Large B-Cell Lymphoma," *Blood*, 92 (1), 234-240 (1998).
Rimsza et al., "Loss of MHC Class II Gene and Protein Expression in Diffuse Large B-cell Lymphoma is Related to Decreased Tumor Immunosurveillance and Poor Patient Survival Regardless of Other Prognostic Factors: a Follow-Up Study from the Leukemia and Lymphoma Molecular Profiling Project," *Blood*, 103, 4251-4258 (2004).
Rogge et al., "Gene Profiling of Lymphoma, Myeloma, and AML," *Medscape from WebMed*, 5 (3), 1-8 (2003).
Rosenwald et al., "Molecular Diagnosis of Primary Mediastinal B Cell Lymphoma Identifies a Clinically Favorable Subgroup of Diffuse Large B Cell Lymphoma Related to Hodgkin Lymphoma," *J. Exp. Med.*, 198 (6), 851-862 (2003).
Rosenwald et al., "The Use of Molecular Profiling to Predict Survival after Chemotherpy for Diffuse Large B-Cell Lymphoma," *New Eng. J. Med.*, 346 (25),1937-1947 (2002).
Rosenwald, et al., "The Proliferation Gene Expression Signature is a Quantitative Integrator of Oncogenic Events that Predicts Survival in Mantle Cell Lymphoma," *Cancer Cell*, 3,185-197 (2003.
Savage et al., "The Molecular Signature of Mediastinal Large B-Cell Lymphoma Differs from that of Other Diffuse Large B-cell Lymphomas and Shares Features with Classical Hodgkin Lymphoma," *Blood*, 102, 3871-3879 (2003).
Schwaenen et al., "DNA Microarray Analysis in Malignant Lymphomas," *Ann Hematol.*, 82, 323-332 (2003).
Sehn et al., "The Revised International Prognostic Index (R-IPI) is a Better Predictor of Outcome than the Standard IPI for Patients with Diffuse Large B-cell Lymphoma Treated with R-CHOP," *Blood*, 109, 1857-1861 (2007).
Shaffer et al., "A Library of Gene Expression Signatures to Illuminate Normal and Pathological Lymphoid Biology," *Immunol. Rev.*, 210, 67-85 (2006).
Shaffer et al., "Lymphoid Malignancies: The Dark Side of B-Cell Differentiation," *Nature Reviews Immunol.*, 2, 920-932 (2002).
Shipp et al., "Diffuse Large B-cell Lymphoma Outcome Prediction by Gene-Expression Profiling and Supervised Machine Learning," *Nature Medicine*, 8 (1), 68-74 (2002).
Shipp et al., "A Predictive Model for Aggressive Non-Hodgkin's Lymphoma," *N. Engl. J. Med.*, 329, 987-994 (1993).
Sonoki et al., "Cyclin D3 is a Target Gene of t(6;14)(p21.1;q32.3) of Mature B-Cell Malignancies," *Blood*, 98, 2837-2844 (2001).
Spellman et al., "Comprehensive Identification of Cell Cycle-Regulated Genes of the Yeast *Saccharomyces cerevisiae* by Microarray Hybridization," Mol. *Biol. Cell*, 9, 3273-3297 (1998).
Staudt et al., "The Biology of Human Lymphoid Malignancies Revealed by Gene Expression Profiling," *Adv. Immunol.*, 87, 163-208 (2005).
Staudt et al., "Genomic Views of the Immune System," *Annu. Rev. Immunol.*, 18, 829-859 (2000).
Staudt, "Gene Expression Profiling of Lymphoid Malignancies," *Annu. Rev. Med.*, 53, 303-318 (2002).
Staudt, "It's ALL in the Diagnosis: The molecular diagnosis of human cancer will hasten the development of treatments tailored to the abnormalities present in each patient's tumor cells. Recent gene expression profiling studies of pediatric acute lymphoblastic leukemia (ALL) suggest that the molecular diagnosis of these diseases is right around the corner," *Cancer Cell*, 1, 109-110 (2002).
Staudt et al., "Focus on Lymphomas," *Cancer Cell*, 2, 363-366 (2002).
Staudt et al., "Molecular Diagnosis of the Hematologic Cancers," *N. Engl. J. Med.*, 348, 1777-1785 (2003).
Subramanian et al., "Gene Set Enrichment Analysis: A Knowledge-based approach for Interpreting Genome-Wide Expression Profiles," *Proc. Nat'l. Acad. Sci. USA*, 102 (43), 15545-15550 (2005).
Supplementary European Search Report, Application No. 04783330.6, dated Jul. 10, 2008.
Tagawa et al., "Comparison of Genome Profiles for Identification of Distinct Subgroups of Diffuse Large B-cell Lymphoma," *Blood*, 106, 1770-1777 (2005).
Tamayo et al., "Interpreting Patterns of Gene Expression with Self-Organizing Maps: Methods and Application to Hematopoietic Differentiation," *Proc. Nat'l. Acad. Sci. USA*, 96, 2907-2912 (1999).
Tavazoie et al., "Systematic Determination of Genetic Network Architecture," *Nature Genet.*, 22, 281-285 (1999).
Wells, "Lymphoma Microenvironment Impacts Therapy and Prognosis," *Hematology Times*, http://www.hematologytimes.com/ht/ p_article_print.do?id=437§ion (2008).
Winter et al., "Prognostic Significance of Bcl-6 Protein Expression in DLBCL treated with CHOP or R-CHOP: a Prospective Correlative Study," *Blood*, 107, 4207-4213 (2006).
Wright, et al., "A Gene Expression-based Method to Diagnose Clinically Distinct Subgroups of Diffuse Large B Cell Lymphoma," *Proc. Natl. Acad. Sci. USA*, 100 (17), 9991-9996 (2003).
Yatabe et al., "Significance of Cyclin D1 Overexpression for the diagnosis of Mantle Cell Lymphoma: a Clinicopathologic Comparison of Cyclin D1-positive MCL and Cyclin D1-negative MCL-like B-cell Lymphoma," *Blood*, 95 (7), 2253-2261 (2000).

(56) References Cited

OTHER PUBLICATIONS

Ye et al., "Variable Frequencies of t(11;18)(q21;q21) in MALT Lymphomas of Different Sites: Significant Association with CagA Strains of *H pylori* in gastric MALT Lymphoma," Blood, 102, 1012-1018 (2003).
Zeller et al., "An Integrated Database of Genes Responsive to the Myc Oncogenic Transcription Factor; identification of Direct Genomic Targets," *Genome Biol.*, 4 (10), R69.1-R69.10 (2003).

\* cited by examiner

SURVIVAL PREDICTOR FOR DIFFUSE LARGE B CELL LYMPHOMA

CROSS-REFERENCE TO RELATED APPLICATION

This application is a continuation application of U.S. patent application Ser. No. 12/996,489, filed Feb. 24, 2011, which is a U.S. National Phase of International Patent Application No. PCT/US2009/046421, flied Jun. 5, 2009, which claims the benefit of U.S. Provisional Patent Application No. 61/059,678, filed on Jun. 6, 2008, the disclosure of which is incorporated b reference.

STATEMENT REGARDING FEDERALLY SPONSORED RESEARCH AND DEVELOPMENT

This invention was made with government support under Grant No. U01 CA084967, awarded by NIH. The government has certain rights in the invention.

INCORPORATION-BY-REFERENCE OF MATERIAL SUBMITTED ELECTRONICALLY

Incorporated by reference in its entirety herein is a computer-readable nucleotide/amino acid sequence listing submitted concurrently herewith and identified as follows: One 1,231,765 Byte ASCII (Text) file named "719123ST25.TXT," created on Nov. 12, 2014.

BACKGROUND OF THE INVENTION

The current standard of care for the treatment of diffuse large B cell lymphoma (DLBCL) includes anthracycline-based chemotherapy regimens such as CHOP in combination with the administration of the anti-CD20 monoclonal antibody Rituximab. This combination regimen (R-CHOP) can cure about 60% of patients and has improved the overall survival of DLBCL patients by 10-15% (Coiffier et al., *N. Engl. J. Med*, 346: 235-42 (2002)). Nonetheless, the molecular basis of response or resistance to this therapy is unknown.

DLBCL is a molecularly heterogeneous disease (Staudt et al., *Adv. Immunol.*, 87: 163-208 (2005)), and different molecular subtypes of DLBCL can have very different prognoses following treatment. For example, gene expression profiling has identified two molecular subtypes of DLBCL that are biologically and clinically distinct (Rosenwald et al., *N. Engl. J. Med.*, 346: 1937-47 (2002); Alizadeh et al., *Nature*, 403: 503-11 (2000)). The germinal center B cell-like (GCB) DLBCL subtype likely arises from normal germinal center B cells, whereas the activated B cell-like (ABC) DLBCL subtype may arise from a post-germinal center B cell that is blocked during plasmacytic differentiation. Many oncogenic mechanisms distinguish these subtypes: GCB DLBCLs have recurrent t(14,18) translocations, whereas ABC DLBCLs have recurrent trisomy 3 and deletion of the INK4a/ARF locus as well as constitutive activation of the anti-apoptotic NF-kB signalling pathway (Rosenwald et al., *N. Engl. J. Med.*, 346: 1937-47 (2002); Bea et al., *Blood*, 106: 3183-90 (2005); Tagawa et al., *Blood*, 106: 1770-77 (2005); Davis et al., *J. Exp. Med.*, 194:1861-74 (2001); Ngo et al., *Nature*, 441: 106-10 (2006); Lenz et al., *Science*, 319: 1676-79 (2008)). When treated with CHOP-like chemotherapy, the overall survival rates of patients with GCB DLBCL and ABC DLBCL were 60% and 30%, respectively (Wright et al., *Proc. Nat'l. Acad. Sci. USA*, 100: 9991-96 (2003)). Thus, the prognosis for different DLBCL can vary widely.

A separate analytical approach identified four gene expression signatures that reflect distinct DLBCL tumor attributes and that were associated with distinct survival profiles in CHOP-treated DLBCL patients (Rosenwald et al., *N. Engl. J. Med.*, 346: 1937-47 (2002)). A "germinal center B cell" (GCB) signature was associated with a favorable prognosis and paralleled the distinction between ABC and GCB DLBCL. The "proliferation" signature was associated with an adverse prognosis and included MYC and its target genes. The "MHC class II" signature was silenced in the malignant cells in a subset of DLBCL cases, an event that was associated with inferior survival (Rosenwald et al., *N. Engl. J. Med.*, 346: 1937-47 (2002); Rimsza et al., *Blood*, 103: 4251-58 (2004)). A fourth prognostic signature, termed "lymph node" signature was associated with favorable prognosis and included components of the extracellular matrix, suggesting that it reflects the nature of the tumor-infiltrating non-malignant cells. These signatures predicted survival in a statistically independent fashion, indicating that multiple biological variables dictate the response to CHOP chemotherapy in DLBCL.

Reports have suggested that the benefit of Rituximab immunotherapy might be restricted to certain molecular subtypes of DLBCL. High expression of BCL-2 or low expression of BCL-6 was associated with inferior survival with CHOP therapy. However, this distinction disappeared with R-CHOP therapy (Mounier et al., *Blood*, 101: 4279-84 (2003); Winter et al., *Blood*, 107: 4207-13 (2006)). Immunohistochemistry has also been used to distinguish DLBCLs with a germinal center versus post-germinal center phenotype. Although such immunohistochemical phenotypes were prognostically significant in CHOP-treated cases, they were not prognostic for R-CHOP-treated cases (Nyman et al., *Blood*, 109: 4930-35 (2007)).

Accordingly, there is a need for new methods of distinguishing among DLBCL subtypes that is prognostically significant for R-CHOP-treated patients.

BRIEF SUMMARY OF THE INVENTION

The invention provides methods and arrays related to a gene expression-based survival predictor for DLBCL patients, including patients treated with the current standard of care, which includes chemotherapy and the administration of Rituximab.

The invention provides a method of predicting the survival outcome of a subject suffering from diffuse large B cell lymphoma (DLBCL) that includes obtaining a gene expression profile from one or more DLBCL biopsy samples from the subject. The gene expression profile, which can be derived from gene expression product isolated from the one or more biopsy samples, includes an expression level for each gene in a germinal center B cell (GCB) gene expression signature and each gene in a stromal-1 gene expression signature. From the gene expression profile, a GCB signature value and a stromal-1 signature value are derived. From these values, a survival predictor score can be calculated using an equation that includes subtracting [(x)*(the GCB signature value)] and subtracting [(y)*(the stromal-1 signature value)]. In the equation, (x) and (y) are scale factors. A lower survival predictor score indicates a more favorable survival outcome, and a higher survival predictor score indicates a less favorable survival outcome for the subject.

The invention also provides a method of generating a survival estimate curve for subjects suffering from DLBCL. Generally the method includes obtaining a gene expression profile from one or more DLBCL biopsy samples taken from each member of a plurality of subjects. Each gene expression profile, which can be derived from gene expression product isolated from the one or more biopsy samples taken from each subject, includes an expression level for each gene in a GCB expression signature, a stromal-1 gene expression signature, and a stromal-2 gene expression signature. For each subject, the GCB signature value, the stromal-1 signature value, and the stromal-2 signature value are determined from the subject's gene expression profile, and, for each subject, a survival predictor score is generated. Each subject's survival outcome following treatment for DLBCL is tracked. A survival estimate curve is generated which correlates the probability of the tracked survival outcome with time following treatment for DLBCL and which also correlates the tracked outcome over time with the survival predictor score for the subjects.

The invention additionally provides a method of predicting the survival outcome of a subject suffering from DLBCL. Generally, the method includes obtaining a gene expression profile from one or more DLBCL biopsy samples from the subject. The gene expression profile, which can be derived from gene expression product isolated from the one or more biopsy samples, includes an expression level for each gene in a GCB gene expression signature, each gene in a stromal-1 gene expression signature, and each gene in a stromal-2 gene expression signature. The GCB signature value, the stromal-1 signature value, and the stromal-2 signature value are determined from the gene expression profile. The method then includes calculating a survival predictor score using the equation:

survival predictor score=$A-[(x)$*(the GCB signature value)]$-[(y)$*(the stromal-1 signature value)]$+[(z)$*(the stromal-2 signature value)].

In this equation, A is an offset term, and (x), (y), and (z) are scale factors. The method further includes calculating the probability of a survival outcome for the subject beyond an amount of time t following treatment for DLBCL, wherein the subject's probability of the survival outcome P(SO) is calculated using the equation:

$$P(SO)=SO_0(t)^{(exp((s)*survival\ predictor\ score))}$$

In this equation, $SO_0(t)$ is the probability of the survival outcome, which corresponds to the largest time value smaller than t in a survival outcome curve, and wherein (s) is a scale factor.

Furthermore, the invention provides a method of evaluating a subject for antiangiogenic therapy of DLBCL. The method includes obtaining a gene expression profile from one or more DLBCL biopsy samples from the subject. The gene expression profile, which can be derived from gene expression product isolated from the one or more biopsy samples, includes an expression level for each gene in a stromal-2 signature. The subject's stromal-2 signature value is then derived from the gene expression profile and evaluated to determine whether the subject's stromal-2 signature value is higher or lower than a standard stromal-2 value. If the subject's stromal-2 signature value is higher than the standard stromal-2 value, then antiangiogenic therapy is indicated, and the subject can be treated with antiangiogenic therapy. If the subject's stromal-2 signature value is not higher than the standard stromal-2 value, then antiangiogenic therapy is not indicated.

The invention also provides a second method of evaluating a subject for antiangiogenic therapy of DLBCL. The method includes obtaining a gene expression profile from one or more DLBCL biopsy samples from the subject. The gene expression profile, which can be derived from gene expression product isolated from the one or more biopsy samples, includes an expression level for each gene in a stromal-1 signature and in a stromal-2 signature. The subject's stromal-1 signature value and stromal-2 signature value are then derived from the gene expression profile. The stromal-1 signature value is subtracted from the stromal-2 signature value to thereby obtain the subject's stromal score. The subject's stromal score is evaluated to determine whether it is higher or lower than a standard stromal score. If the subject's stromal score is higher than the standard stromal score, then antiangiogenic therapy is indicated, and the subject can be treated with antiangiogenic therapy. If the subject's stromal score is not higher than the standard stromal-score, then antiangiogenic therapy is not indicated.

Additionally, the invention provides a machine-readable medium containing a digitally encoded GCB signature value, a digitally encoded stromal-1 signature value, a digitally encoded stromal-2 signature, or any combination of the foregoing signature values obtained from a subject suffering from DLBCL.

In another embodiment the invention provides a machine-readable medium containing the digitally encoded survival predictor score obtained using a method disclosed herein for predicting the survival outcome of a subject suffering from diffuse large B cell lymphoma (DLBCL). In yet another embodiment, the invention provides a machine-readable medium containing the survival estimate curve obtained using a method disclosed herein for generating a survival estimate curve for subjects suffering from DLBCL. In still another embodiment, the invention provides a machine-readable medium containing the digitally encoded probability of survival calculated according to a method disclosed herein for predicting the survival outcome (e.g., progression-free survival or overall survival) of a subject suffering from DLBCL. Furthermore, the invention provides a machine-readable medium containing the digitally encoded stromal score generated by a method disclosed herein for evaluating a subject for antiangiogenic therapy of DLBCL.

The invention also provides a targeted array comprising at least one probe or at least one set of probes for each gene in a germinal center B cell gene (GCB) expression signature, a stromal-1 gene expression signature, and a stromal-2 gene expression signature. The array can include probes for fewer than 20,000 genes or fewer than 10,000 genes.

DETAILED DESCRIPTION OF THE INVENTION

Figure 1A:
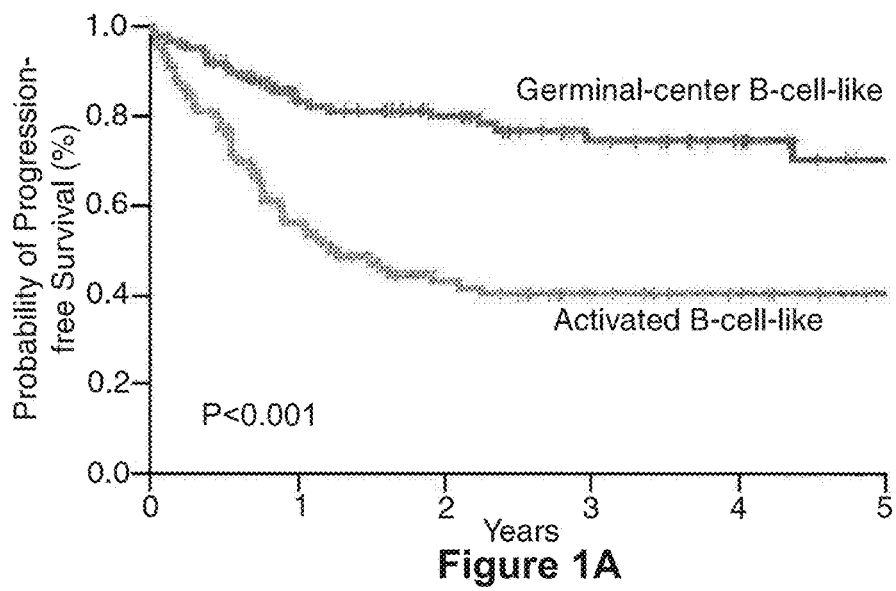
FIG. 1A is a Kaplan-Meier estimates plot depicting the probability of progression-free-survival versus time (in years) of patients with GCB DLBCL and ABC DLBCL. The plot indicates that GCB patients have a more favorable, i.e., higher probability of progression-free survival rate than ABC patients for at least five years following R-CHOP therapy.

The invention provides a gene expression-based survival predictor for DLBCL patients, including those patients receiving the current standard of care, R-CHOP. The survival predictor can be used to determine the relative probability of a survival outcome in a specific subject. The survival predictor can also be used to predict; i.e., determine the expected probability that a survival outcome will occur by a defined period following treatment for DLBCL. Such prognostic information can be very useful to both the patient and the physician. Patients with survival predictor scores that indicate inferior outcome with R-CHOP therapy could be candidates for a different therapeutic regimen, if, for example, they relapse from R-CHOP treatment. The survival predictor can also be used in the design of clinical studies and analysis of clinical data to provide a quantitative survey of the types of DLBCL patients from which clinical data was gathered. The predictor can be used to improve one or more comparisons between data from different sources (e.g., from different clinical trials), by enabling comparisons with respect to patient characteristics, which are manifested in the gene expression levels that determine and, thus, are embodied in the predictor. Furthermore, the invention provides information that can be very valuable to a DLBCL patient, since the patient may be inclined to order his or her life quite differently, depending on whether the patient has a high or low probability of surviving and/or remaining progression-free for a period of time following treatment.

The following abbreviations are used herein: ABC, activated B cell-like diffuse large B cell lymphoma; CHOP, cyclophosphamide, doxorubicine, vincristine, and prednisone; CI, confidence interval; COP, cyclophosphamide, vincristine, and prednisone; DLBCL, diffuse large B cell lymphoma; DOD, dead of disease; ECOG, Eastern Cooperative Oncology Group; FACS, fluorescence-activated cell sorting; FH, follicular hyperplasia; FISH, fluorescence in situ hybridization; FL, follicular lymphoma; GC, germinal center; GCB, germinal center B cell-like diffuse large B cell lymphoma; IPI, International Prognostic Index; LPC, lymphoplasmacytic lymphoma; MHC, major histocompatibility complex; NA, not available or not applicable; NK, natural killer; PCR, polymerase chain reaction; RQ-PCR, real-time quantitative PCR; RT-PCR, reverse transcriptase polymerase chain reaction; SAGE, serial analysis of gene expression; WHO, World Health Organization.

The term "R-CHOP" as used herein refers generally to any therapeutic regimen that includes chemotherapy and the administration of Rituximab. Accordingly, while the term can refer to a Rituximab combination therapy that includes a CHOP regimen of cyclophosphamide, doxorubicine, vincristine, and prednisone, the term R-CHOP can also refer to therapy that includes Rituximab in combination with a chemotherapeutic regimen other than CHOP.

The phrase "gene expression data" as well as "gene expression level" as used herein refers to information regarding the relative or absolute level of expression of a gene or set of genes in a cell or group of cells. The level of expression of a gene may be determined based on the level of RNA, such as mRNA, encoded by the gene. Alternatively, the level of expression may be determined based on the level of a polypeptide or fragment thereof encoded by the gene. Gene expression data may be acquired for an individual cell, or for a group of cells such as a tumor or biopsy sample. Gene expression data and gene expression levels can be stored on computer readable media, e.g., the computer readable medium used in conjunction with a microarray or chip reading device. Such gene expression data can be manipulated to generate gene expression signatures.

The term "microarray," "array," or "chip" refers to a plurality of nucleic acid probes coupled to the surface of a substrate in different known locations. The substrate is preferably solid. Microarrays have been generally described in the art in, for example, U.S. Pat. No. 5,143,854 (Pirrung), U.S. Pat. No. 5,424,186 (Fodor), U.S. Pat. No. 5,445,934 (Fodor), U.S. Pat. No. 5,677,195 (Winkler), U.S. Pat. No. 5,744,305 (Fodor), U.S. Pat. No. 5,800,992 (Fodor), and U.S. Pat. No. 6,040,193 (Winkler), and Fodor et al., *Science*, 251: 767-777 (1991).

The term "gene expression signature" or "signature" as used herein refers to a group of coordinately expressed genes. The genes making up this signature may be expressed in a specific cell lineage, stage of differentiation, or during a particular biological response. The genes can reflect biological aspects of the tumors in which they are expressed, such as the cell of origin of the cancer, the nature of the non-malignant cells in the biopsy, and the oncogenic mechanisms responsible for the cancer (Shaffer et al., *Immunity*, 15: 375-385 (2001)). Examples of gene expression signatures include lymph node, proliferation (Rosenwald et al., *New Engl. J. Med.*, 346: 1937-1947 (2002)), MHC class II, ABC DLBCL high, B cell differentiation, T-cell, macrophage, immune response-1, and immune response-2 signatures (U.S. Patent Application Publication No. 2007/0105136 (Staudt)).

The term "signature value" as used herein corresponds to a mathematical combination of measurements from expression levels of the genes in a gene expression signature. An exemplary signature value is a signature average which corresponds to the average or mean of the individual expression levels in a gene expression signature.

The phrase "survival predictor score" as used herein refers to a score generated by a multivariate model used to predict survival based on gene expression. A subject with a higher survival predictor score is predicted to have poorer survival than a subject with a lower survival predictor score.

The term "survival" or "overall survival" as used herein may refer to the probability or likelihood of a subject surviving for a particular period of time. Alternatively, it may refer to the likely term of survival for a subject, such as expected mean or median survival time for a subject with a particular gene expression pattern.

The term "progression free survival" as used herein can refer to the probability or likelihood of a subject surviving without significant progression or worsening of disease for a particular period of time. Alternatively, it may refer to the likely term for a subject of survival without significant progression or worsening of disease, such as expected mean or median survival time for a subject with a particular gene expression pattern without significant progression or worsening of disease.

The term "survival outcome" as used herein may refer to survival, overall survival, or progression free survival.

The phrase "scale factor" as used herein refers to a factor that relates change in gene expression to prognosis. An example of a scale factor is a factor obtained by maximizing the partial likelihoods of the Cox proportional hazards model.

The gene expression signatures, signature values, survival predictor scores, stromal scores, survival estimate curves, and probabilities of survival disclosed herein may be stored in digitally encoded format on computer readable media, e.g., computer readable media used in conjunction with microarray or chip reading devices or computer readable media used to store patient data during treatment for DLBCL. Such media and the specialized devices that use them, e.g., for diagnostic and clinical applications, are known in the art.

The invention provides a method for predicting a survival outcome in a subject diagnosed with DLBCL using gene expression data. Such data may be gathered using any effective method of quantifying gene expression. For example, gene expression data may be measured or estimated using one or more microarrays. The microarrays may be of any effective type, including, but not limited to, nucleic acid based or antibody based. Gene expression may also be measured by a variety of other techniques, including, but not limited to, PCR, quantitative RT-PCR, real-time PCR, RNA amplification, in situ hybridization, immunohistochemistry, immunocytochemistry, FACS, serial analysis of gene expression (SAGE) (Velculescu et al., *Science*, 270: 484-87 (1995)), Northern blot hybridization, or western blot hybridization.

Nucleic acid microarrays generally comprise nucleic acid probes derived from individual genes and placed in an ordered array on a support. This support may be, for example, a glass slide, a nylon membrane, or a silicon wafer. Gene expression patterns in a sample are obtained by hybridizing the microarray with the gene expression product from the sample. This gene expression product may be, for example, total cellular mRNA, rRNA, or cDNA obtained by reverse transcription of total cellular mRNA. The gene expression product from a sample is labeled with a radioactive, fluorescent, or other label to allow for detection. Following hybridization, the microarray is washed, and hybridization of the gene expression product to each nucleic acid probe on the microarray is detected and quantified using a detection device such as a phosphorimager or scanning confocal microscope.

There are two broad classes of microarrays: cDNA and oligonucleotide arrays. cDNA arrays consist of hundreds or thousands of cDNA probes immobilized on a solid support. These cDNA probes are usually 100 nucleotides or greater in size. There are two commonly used designs for cDNA arrays. The first is the nitrocellulose filter array, which is generally prepared by robotic spotting of purified DNA fragments or lysates of bacteria containing cDNA clones onto a nitrocellulose filter (Southern et al., *Genomics*, 13: 1008-17 (1992); Southern et al., *Nucl Acids Res* 22: 1368-73 (1994); Gress et al., *Oncogene*, 13: 1819-30 (1996); Pietu et al., *Genome Res.*, 6: 492-503 (1996)). The other commonly used cDNA arrays is fabricated by robotic spotting of PCR fragments from cDNA clones onto glass microscope slides (Schena et al., *Science*, 270: 467-70 (1995); DeRisi et al., *Nature Genet.*, 14: 457-60 (1996); Schena et al., *Proc. Nat'l. Acad. Sci. USA*, 93: 10614-19 (1996); Shalon et al., *Genome Res.*, 6: 639-45 (1996); DeRisi et al., *Science*, 278: 680-86 (1997); Heller et al., *Proc. Nat'l. Acad. Sci. USA*, 94: 2150-55 (1997); Lashkari et al., *Proc. Nat'l. Acad. Sci. USA*, 94: 13057-62 (1997)). These cDNA microarrays are simultaneously hybridized with two fluorescent cDNA probes, each labeled with a different fluorescent dye (typically Cy3 or Cy5). In this format, the relative mRNA expression in two samples is directly compared for each gene on the microarray. Oligonucleotide arrays differ from cDNA arrays in that the probes are 20- to 25-mer oligonucleotides. Oligonucleotide arrays are generally produced by in situ oligonucleotide synthesis in conjunction with photolithographic masking techniques (Pease et al., *Proc. Nat'l. Acad. Sci. USA*, 91: 5022-26 (1994); Lipshutz et al., *Biotechniques* 19: 442-47 (1995); Chee et al., *Science*, 274: 610-14 (1996); Lockhart et al., *Nature Biotechnol.*, 14: 1675-80 (1996); Wodicka et al., *Nature Biotechnol.*, 15: 1359-6714 (1997)). The solid support for oligonucleotide arrays is typically a glass or silicon surface.

Methods and techniques applicable to array synthesis and use have been described in, for example, U.S. Pat. No. 5,143,854 (Pirrung), U.S. Pat. No. 5,242,974 (Holmes), U.S. Pat. No. 5,252,743 (Barrett), U.S. Pat. No. 5,324,633 (Fodor), U.S. Pat. No. 5,384,261 (Winkler), U.S. Pat. No. 5,424,186 (Fodor), U.S. Pat. No. 5,445,934 (Fodor), U.S. Pat. No. 5,451,683 (Barrett), U.S. Pat. No. 5,482,867 (Barrett), U.S. Pat. No. 5,491,074 (Aldwin), U.S. Pat. No. 5,527,681 (Holmes), U.S. Pat. No. 5,550,215 (Holmes), U.S. Pat. No. 5,571,639 (Hubbell), U.S. Pat. No. 5,578,832 (Trulson), U.S. Pat. No. 5,593,839 (Hubbell), U.S. Pat. No. 5,599,695 (Pease), U.S. Pat. No. 5,624,711 (Sundberg), U.S. Pat. No. 5,631,734 (Stern), U.S. Pat. No. 5,795,716 (Chee), U.S. Pat. No. 5,831,070 (Pease), U.S. Pat. No. 5,837,832 (Chee), U.S. Pat. No. 5,856,101 (Hubbell), U.S. Pat. No. 5,858,659 (Sapolsky), U.S. Pat. No. 5,936,324 (Montagu), U.S. Pat. No. 5,968,740 (Fodor), U.S. Pat. No. 5,974,164 (Chee), U.S. Pat. No. 5,981,185 (Matson), U.S. Pat. No. 5,981,956 (Stern), U.S. Pat. No. 6,025,601 (Trulson), U.S. Pat. No. 6,033,860 (Lockhart), U.S. Pat. No. 6,040,193 (Winkler), U.S. Pat. No. 6,090,555 (Fiekowsky), and U.S. Pat. No. 6,410,229 (Lockhart), and U.S. Patent Application Publication No. 2003/0104411 (Fodor).

Microarrays may generally be produced using a variety of techniques, such as mechanical or light directed synthesis methods that incorporate a combination of photolithographic methods and solid phase synthesis methods. Techniques for the synthesis of microarrays using mechanical synthesis methods are described in, for example, U.S. Pat. No. 5,384,261 (Winkler) and U.S. Pat. No. 6,040,193 (Winkler). Although a planar array surface is preferred, the microarray may be fabricated on a surface of virtually any shape, or even on a multiplicity of surfaces. Microarrays may be nucleic acids on beads, gels, polymeric surfaces, fibers such as fiber optics, glass, or any other appropriate substrate. See, for example, U.S. Pat. No. 5,708,153 (Dower), U.S. Pat. No. 5,770,358 (Dower), U.S. Pat. No. 5,789,162 (Dower), U.S. Pat. No. 5,800,992 (Fodor), and U.S. Pat. No. 6,040,193 (Winkler).

Microarrays can be packaged in such a manner as to allow for diagnostic use, or they can be all-inclusive devices. See, for example, U.S. Pat. No. 5,856,174 (Lipshutz) and U.S. Pat. No. 5,922,591 (Anderson).

Microarrays directed to a variety of purposes are commercially available from Affymetrix (Santa Clara, Calif.). For instance, these microarrays may be used for genotyping and gene expression monitoring.

Gene expression data can be used to identify genes that are coordinately regulated. Genes that encode components of the same multi-subunit protein complex are often coordinately regulated. Coordinate regulation is also observed among genes whose products function in a common differentiation program or in the same physiological response pathway. Recent application of gene expression profiling to the immune system has shown that lymphocyte differentiation and activation are accompanied by parallel changes in expression among hundreds of genes. Gene expression databases may be used to interpret the pathological changes in gene expression that accompany autoimmunity, immune deficiencies, cancers of immune cells and of normal immune responses.

Scanning and interpreting large bodies of relative gene expression data is a formidable task. This task is greatly facilitated by algorithms designed to organize the data in a way that highlights systematic features, and by visualization tools that represent the differential expression of each gene as varying intensities and hues of color (Eisen et al., *Proc. Nat'l. Acad. Sci. USA*, 95: 14863-68 (1998)). The development of microarrays, which are capable of generating massive amounts of expression data in a single experiment, has greatly increased the need for faster and more efficient methods of analyzing large-scale expression data sets. In order to effectively utilize microarray gene expression data for the prediction of survival in DLBCL patients, there is a need for new algorithms to be developed, which can identify important information and convert it to a more manageable format. In addition, the microarrays used to generate this data can be streamlined to incorporate probe sets that are useful for survival outcome prediction.

Mathematical analysis of gene expression data is a rapidly evolving science based on a rich mathematics of pattern recognition developed in other contexts (Kohonen, *Self-Organizing Maps*, Springer Press (Berlin 1997)). Mathematical analysis of gene expression data can be used, for example, to identify groups of genes that are coordinately regulated within a biological system, to recognize and interpret similarities between biological samples on the basis of similarities in gene expression patterns, and/or to recognize and identify those features of a gene expression pattern that are related to distinct biological processes or phenotypes.

Mathematical analysis of gene expression data often begins by establishing the expression pattern for each gene on an array across a number (n) of experimental samples. The expression pattern of each gene can be represented by a point in n-dimensional space, with each coordinate specified by an expression measurement in one of the n samples (Eisen et al., *Proc. Nat'l. Acad. Sci. USA*, 95: 14863-68 (1998)). A clustering algorithm that uses distance metrics can then be applied to locate clusters of genes in this n-dimensional space. These clusters indicate genes with similar patterns of variation in expression over a series of experiments. Clustering methods that have been applied to microarray data in the past include hierarchical clustering (Eisen et al., supra), self-organizing maps (SOMs) (Tamayo et al., *Proc. Nat'l. Acad. Sci. USA*, 96: 2907-12 (1999)), k-means (Tavazoie et al., *Nature Genet.*, 22: 281-85 (1999)), and deterministic annealing (Alon et al., *Proc. Nat'l. Acad. Sci. USA*, 96: 6745-50 (1999)).

A variety of different algorithms, each emphasizing distinct orderly features of the data, may be required to glean the maximal biological insight from a set of samples (Alizadeh et al., *J. Clin. Immunol.*, 18: 373-79 (1998)). One such algorithm, hierarchical clustering, begins by determining the gene expression correlation coefficients for each pair of the n genes studied. Genes with similar gene expression correlation coefficients are grouped next to one another in a hierarchical fashion. Generally, genes with similar expression patterns under a particular set of conditions can encode protein products with related roles in the physiological adaptation to those conditions. Novel genes of unknown function that are clustered with a large group of functionally related genes likely participate in similar or related biological process. Likewise, other clustering methods mentioned herein can also group genes together that encode proteins with related biological function.

In such clustering methods, genes that are clustered together reflect a particular biological function, and are termed gene expression signatures (Shaffer et al., *Immunity* 15: 375-85 (2001)). One general type of gene expression signature includes genes that are characteristically expressed in a particular cell type or at a particular stage of cellular differentiation or activation. Another general type of gene expression signature includes genes that are regulated in their expression by a particular biological process such as proliferation, or by the activity of a particular transcription factor or signaling pathway.

The pattern of gene expression in a biological sample can provide a distinctive and accessible molecular picture of its functional state and identity (DeRisi et al., *Science*, 278: 680-86 (1997); Cho et al., *Mol. Cell.*, 2: 65-73 (1998); Chu et al., *Science*, 282: 699-705 (1998); Holstege et al., *Cell.*, 95: 717-728 (1998); Spellman et al., *Mol. Biol. Cell*, 9: 3273-97 (1998)). Each cell transduces variations in its environment, internal state, and developmental state into readily measured and recognizable variations in its gene expression patterns. Two different samples with related gene expression patterns are therefore likely to be biologically and functionally similar to one another. Thus, a specific gene expression signature in a sample can provide important biological insights into its cellular composition and the function of various intracellular pathways within those cells.

Databases of gene expression signatures have proven useful in elucidating the complex gene expression patterns of various cancers. For example, the expression pattern of genes in the germinal center B cell signature in a lymphoma biopsy indicates that the lymphoma includes cells derived from the germinal center stage of differentiation. In the same lymphoma biopsy, the expression of genes from the T cell signature can be used to estimate the degree of infiltration of the tumor by host T cells, while the expression of genes from the proliferation signature can be used to quantitate the tumor cell proliferation rate. In this manner, gene expression signatures provide an "executive summary" of the biological properties of a tumor specimen. Gene expression signatures can also be helpful in interpreting the results of a supervised analysis of gene expression data. A supervised analysis generates a list of genes with expression patterns that correlate with survival. Gene expression signatures can be useful in assigning these "predictive" genes to functional categories. In building a multivariate model of survival based on gene expression data, this functional categorization helps to limit the inclusion of multiple genes in the model that measure the same aspect of tumor biology.

This following approach was utilized to create the survival prediction models for DLBCL of the invention. Gene expression profiles were used to create multivariate models for predicting survival. The methods for creating these models were "supervised" in that they used clinical data to guide the selection of genes to be used in the prognostic classification. The method identified genes with expression patterns that correlated with the length of overall survival following chemotherapy. Generally the process for identifying the multivariate model for predicting survival included the following steps:

1. Genes were identified having expression patterns univariately associated with a particular clinical outcome using a Cox proportional hazards model. Generally, a univariate p-value of <0.01 is considered the cut-off for significance (however, another criterion can be used). These genes were termed "predictor" genes.
2. Within a set of predictor genes, gene expression signatures were identified.
3. For each gene expression signature significantly associated with survival, the average expression of each component genes within this signature was used to generate a gene expression signature value.
4. A multivariate Cox model of clinical outcome using the gene expression signature values was built.
5. Additional genes were added to the model, which added to the statistical power of the model.

The model of the invention generates a survival predictor score, with a higher score being associated with worse clinical outcome. The resulting model can be used separately to predict a survival outcome. Alternatively, the model can be used in conjunction with one or more other models, disclosed herein or in other references, to predict a survival outcome.

The present invention discloses several gene expression signatures related to the clinical outcome of DLBCL patients. The signatures were identified using the clinical data and methods described below in Examples 1 and 2. Three of these gene expression signatures are the germinal center B cell (GCB) signature, the stromal-1 signature, and the stromal-2 signature. Each component gene of these signatures is identified in Table 1 according to its GenBank accession number, its GeneID assigned by Entrez Gene, a common gene symbol, and a descriptive gene title. Table 1 also provides the Affymetrix Probe Set ID, which can be used (e.g., on the Affymetrix U133+ (Affymetrix, Santa Clara, Calif.) microarray) to determine the gene expression level for the indicated gene. The computer-readable sequence listing filed herewith includes a representative fragment sequence (of about 100 bp or greater) for each genomic target sequence listed in Table 1, followed by the sequence for each probe in the corresponding Affymetrix probe set listed in Table 1.

TABLE 1

| Signature | GenBank Accession No. | Entrez GeneID | Gene Symbol | Gene Title | Affymetrix Probe Set ID |
|---|---|---|---|---|---|
| GCB | NM_052932 | 114908 | TMEM123 | transmembrane protein 123 | 211967_at |
| GCB | NM_001014380 | 84056 | KATNAL1 | katanin p60 subunit A-like 1 | 227713_at |
| GCB | NM_004665 | 8875 | VNN2 | vanin 2 | 205922_at |
| GCB | NM_004760 | 9263 | STK17A | serine/threonine kinase 17a (apoptosis-inducing) | 202693_s_at |
| GCB | CR590554 | | | Full-length cDNA clone CS0DF007YJ21 of Fetal brain of *Homo sapiens* (human) | 228464_at |
| GCB | NM_017599 | 55591 | VEZT | vezatin, adherens junctions transmembrane protein | 223089_at |
| GCB | NM_018351 | 55785 | FGD6 | FYVE, RhoGEF and PH domain containing 6 | 1555136_at |
| GCB | NM_001007075 | 51088 | KLHL5 | kelch-like 5 (*Drosophila*) | 226001_at |
| GCB | NM_004845 | 9468 | PCYT1B | phosphate cytidylyltransferase 1, choline, beta | 228959_at |
| GCB | AK026881 | | | CDNA: FLJ23228 fis, clone CAE06654 | 226799_at |
| GCB | NM_018440 | 55824 | PAG1 | phosphoprotein associated with glycosphingolipid microdomains 1 | 225626_at |
| GCB | NM_004965 | 3150 | HMGN1 | high-mobility group nucleosome binding domain 1 | 200944_s_at |
| GCB | NM_001706 | 604 | BCL6 | B cell CLL/lymphoma 6 (zinc finger protein 51) | 228758_at |

TABLE 1-continued

| Signature | GenBank Accession No. | Entrez GeneID | Gene Symbol | Gene Title | Affymetrix Probe Set ID |
|---|---|---|---|---|---|
| GCB | NM_020747 | 57507 | ZNF608 | zinc finger protein 608 | 229817_at |
| GCB | NM_001001695 | 400941 | FLJ42418 | FLJ42418 protein | 231455_at |
| GCB | NM_015055 | 23075 | SWAP70 | SWAP-70 protein | 209306_s_at |
| GCB | NM_005607 | 5747 | PTK2 | PTK2 protein tyrosine kinase 2 | 208820_at |
| GCB | XM_027236 | 23508 | TTC9 | tetratricopeptide repeat domain 9 | 213172_at |
| GCB | BQ213652 | 440864 | LOC440864 | hypothetical gene supported by BC040724 | 1569034_a_at |
| GCB | NM_005574 | 4005 | LMO2 | LIM domain only 2 (rhombotin-like 1) | 204249_s_at |
| GCB | NM_014667 | 9686 | VGLL4 | vestigial like 4 (*Drosophila*) | 212399_s_at |
| GCB | NM_002221 | 3707 | ITPKB | inositol 1,4,5-trisphosphate 3-kinase B | 203723_at |
| GCB | NM_000902 | 4311 | MME | membrane metallo-endopeptidase (neutral endopeptidase, enkephalinase) | 203434_s_at |
| GCB | NM_012446 | 23635 | SSBP2 | single-stranded DNA binding protein 2 | 203787_at |
| GCB | NM_024613 | 79666 | PLEKHF2 | pleckstrin homology domain containing, family F (with FYVE domain) member 2 | 222699_s_at |
| GCB | AV705976 | | | Transcribed locus | 204681_s_at |
| GCB | NM_012108 | 26228 | BRDG1 | BCR downstream signaling 1 | 220059_at |
| GCB | NM_014397 | 10783 | NEK6 | NIMA (never in mitosis gene a)-related kinase 6 | 223158_s_at |
| GCB | NM_018981 | 54431 | DNAJC10 | DnaJ (Hsp40) homolog, subfamily C, member 10 | 225174_at |
| GCB | NM_001379 | 1786 | DNMT1 | DNA (cytosine-5-)-methyltransferase 1 | 227684_at |
| GCB | NM_006152 | 4033 | LRMP | lymphoid-restricted membrane protein | 35974_at |
| GCB | NM_024701 | 79754 | ASB13 | ankyrin repeat and SOCS box-containing 13 | 218862_at |
| GCB | NM_006085 | 10380 | BPNT1 | 3'(2'), 5'-bisphosphate nucleotidase 1 | 232103_at |
| GCB | NM_023009 | 65108 | MARCKSL1 | MARCKS-like 1 | 200644_at |
| GCB | NM_033121 | 88455 | ANKRD13A | ankyrin repeat domain 13A | 224810_s_at |
| GCB | NM_015187 | 23231 | KIAA0746 | KIAA0746 protein | 235353_at |
| GCB | NM_175739 | 327657 | SERPINA9 | serpin peptidase inhibitor, clade A (alpha-1 antiproteinase, antitrypsin), member 9 | 1553499_s_at |
| GCB | NM_001012391 | 400509 | RUNDC2B | RUN domain containing 2B | 1554413_s_at |
| GCB | XM_034274 | 4603 | MYBL1 | v-myb myeloblastosis viral oncogene homolog (avian)-like 1 | 213906_at |
| Stromal-1 | NM_024579 | 79630 | C1orf54 | chromosome 1 open reading frame 54 | 219506_at |
| Stromal-1 | NM_001645 | 341 | APOC1 | apolipoprotein C-I | 213553_x_at |
| Stromal-1 | NM_001562 | 3606 | IL18 | interleukin 18 (interferon-gamma-inducing factor) | 206295_at |
| Stromal-1 | NM_014479 | 27299 | ADAMDEC1 | ADAM-like, decysin 1 | 206134_at |
| Stromal-1 | NM_003465 | 1118 | CHIT1 | chitinase 1 (chitotriosidase) | 208168_s_at |
| Stromal-1 | NM_000954 | 5730 | PTGDS | prostaglandin D2 synthase 21 kDa (brain) | 211748_x_at |
| Stromal-1 | NM_001056 | 6819 | SULT1C1 | sulfotransferase family, cytosolic, 1C, member 1 | 211470_s_at |
| Stromal-1 | NM_018000 | 55686 | MREG | melanoregulin | 219648_at |
| Stromal-1 | NM_001018058 | 22797 | TFEC | transcription factor EC | 206715_at |
| Stromal-1 | NM_000239 | 4069 | LYZ | lysozyme (renal amyloidosis) | 213975_s_at |
| Stromal-1 | NM_006834 | 10981 | RAB32 | RAB32, member RAS oncogene family | 204214_s_at |
| Stromal-1 | NM_000416 | 3459 | IFNGR1 | interferon gamma receptor 1 | 202727_s_at |
| Stromal-1 | NM_004666 | 8876 | VNN1 | vanin 1 | 205844_at |
| Stromal-1 | NM_031491 | 83758 | RBP5 | retinol binding protein 5, cellular | 223820_at |

TABLE 1-continued

| Signature | GenBank Accession No. | Entrez GeneID | Gene Symbol | Gene Title | Affymetrix Probe Set ID |
|---|---|---|---|---|---|
| Stromal-1 | NM_001276 | 1116 | CHI3L1 | chitinase 3-like 1 (cartilage glycoprotein-39) | 209396_s_at |
| Stromal-1 | NM_138434 | 113763 | C7orf29 | chromosome 7 open reading frame 29 | 227598_at |
| Stromal-1 | NM_001005340 | 10457 | GPNMB | glycoprotein (transmembrane) nmb | 201141_at |
| Stromal-1 | NM_002294 | 3920 | LAMP2 | lysosomal-associated membrane protein 2 | 203041_s_at |
| Stromal-1 | NM_002888 | 5918 | RARRES1 | retinoic acid receptor responder (tazarotene induced) 1 | 221872_at |
| Stromal-1 | NM_172248 | 1438 | CSF2RA | colony stimulating factor 2 receptor, alpha, low-affinity (granulocyte-macrophage) | 210340_s_at |
| Stromal-1 | NM_018344 | 55315 | SLC29A3 | solute carrier family 29 (nucleoside transporters), member 3 | 219344_at |
| Stromal-1 | NM_032413 | 84419 | C15orf48 | chromosome 15 open reading frame 48 | 223484_at |
| Stromal-1 | NM_001001851 | 80760 | ITIH5 | inter-alpha (globulin) inhibitor H5 | 1553243_at |
| Stromal-1 | NM_000211 | 3689 | ITGB2 | integrin, beta 2 (complement component 3 receptor 3 and 4 subunit) | 1555349_a_at |
| Stromal-1 | NM_005213 | 1475 | CSTA | cystatin A (stefin A) | 204971_at |
| Stromal-1 | NM_003874 | 8832 | CD84 | CD84 molecule | 205988_at |
| Stromal-1 | NM_000228 | 3914 | LAMB3 | laminin, beta 3 | 209270_at |
| Stromal-1 | NM_005651 | 6999 | TDO2 | tryptophan 2,3-dioxygenase | 205943_at |
| Stromal-1 | NM_001005266 | 283651 | C15orf21 | chromosome 15 open reading frame 21 | 242649_x_at |
| Stromal-1 | AV659177 | | | Transcribed locus | 230391_at |
| Stromal-1 | NM_001747 | 822 | CAPG | capping protein (actin filament), gelsolin-like | 201850_at |
| Stromal-1 | NM_000784 | 1593 | CYP27A1 | cytochrome P450, family 27, subfamily A, polypeptide 1 | 203979_at |
| Stromal-1 | NM_052998 | 113451 | ADC | arginine decarboxylase | 228000_at |
| Stromal-1 | NM_016240 | 51435 | SCARA3 | scavenger receptor class A, member 3 | 219416_at |
| Stromal-1 | Z74615 | | COL1A1 | Collagen, type I, alpha 1 | 217430_x_at |
| Stromal-1 | NM_052947 | 115701 | ALPK2 | alpha-kinase 2 | 228367_at |
| Stromal-1 | NM_021136 | 6252 | RTN1 | reticulon 1 | 210222_s_at |
| Stromal-1 | AL049370 | | | Full-length cDNA clone CL0BB018ZE07 of Neuroblastoma of *Homo sapiens* (human) | 213100_at |
| Stromal-1 | NM_006042 | 9955 | HS3ST3A1 | heparan sulfate (glucosamine) 3-O-sulfotransferase 3A1 | 219985_at |
| Stromal-1 | NM_000041 | 348 | APOE | apolipoprotein E | 203382_s_at |
| Stromal-1 | NM_004994 | 4318 | MMP9 | matrix metallopeptidase 9 (gelatinase B, 92 kDa gelatinase, 92 kDa type IV collagenase) | 203936_s_at |
| Stromal-1 | NM_001831 | 1191 | CLU | clusterin | 222043_at |
| Stromal-1 | NM_002305 | 3956 | LGALS1 | lectin, galactoside-binding, soluble, 1 (galectin 1) | 201105_at |
| Stromal-1 | NM_032024 | 83938 | C10orf11 | chromosome 10 open reading frame 11 | 223703_at |
| Stromal-1 | NM_001025201 | 1123 | CHN1 | chimerin (chimaerin) 1 | 212624_s_at |
| Stromal-1 | NM_003489 | 8204 | NRIP1 | nuclear receptor interacting protein 1 | 202599_s_at |
| Stromal-1 | NM_032646 | 94015 | TTYH2 | tweety homolog 2 (*Drosophila*) | 223741_s_at |
| Stromal-1 | NM_001312 | 1397 | CRIP2 | cysteine-rich protein 2 | 208978_at |
| Stromal-1 | NM_023075 | 65258 | MPPE1 | metallophosphoesterase 1 | 213924_at |
| Stromal-1 | NM_004364 | 1050 | CEBPA | CCAAT/enhancer binding protein (C/EBP), alpha | 204039_at |
| Stromal-1 | NM_000248 | 4286 | MITF | microphthalmia-associated transcription factor | 207233_s_at |

TABLE 1-continued

| Signature | GenBank Accession No. | Entrez GeneID | Gene Symbol | Gene Title | Affymetrix Probe Set ID |
|---|---|---|---|---|---|
| Stromal-1 | NM_002185 | 3575 | IL7R | interleukin 7 receptor | 226218_at |
| Stromal-1 | NM_021638 | 60312 | AFAP | actin filament associated protein | 203563_at |
| Stromal-1 | NM_003786 | 8714 | ABCC3 | ATP-binding cassette, sub-family C (CFTR/MRP), member 3 | 208161_s_at |
| Stromal-1 | | 730351 | LOC730351 | hypothetical protein LOC730351 | 229407_at |
| Stromal-1 | NM_012153 | 26298 | EHF | ets homologous factor | 225645_at |
| Stromal-1 | NM_004887 | 9547 | CXCL14 | chemokine (C-X-C motif) ligand 14 | 222484_s_at |
| Stromal-1 | NM_002030 | 2359 | FPRL2 | formyl peptide receptor-like 2 | 230422_at |
| Stromal-1 | NM_001321 | 1466 | CSRP2 | cysteine and glycine-rich protein 2 | 207030_s_at |
| Stromal-1 | NM_001945 | 1839 | HBEGF | heparin-binding EGF-like growth factor | 203821_at |
| Stromal-1 | NM_031412 | 23710 | GABARAPL1 | GABA(A) receptor-associated protein like 1 | 208869_s_at |
| Stromal-1 | NM_006022 | 8848 | TSC22D1 | TSC22 domain family, member 1 | 215111s_at |
| Stromal-1 | NM_016174 | 51148 | CEECAM1 | cerebral endothelial cell adhesion molecule 1 | 224794_s_at |
| Stromal-1 | NM_015103 | 23129 | PLXND1 | plexin D1 | 212235_at |
| Stromal-1 | NM_003270 | 7105 | TSPAN6 | tetraspanin 6 | 209109_s_at |
| Stromal-1 | NM_000887 | 3687 | ITGAX | integrin, alpha X (complement component 3 receptor 4 subunit) | 210184_at |
| Stromal-1 | NM_001864 | 1346 | COX7A1 | cytochrome c oxidase subunit VIIa polypeptide 1 (muscle) | 204570_at |
| Stromal-1 | CR599008 | | GPR157 | Full-length cDNA clone CS0DJ007YL22 of T cells (Jurkat cell line) Cot 10-normalized of Homo sapiens (human) | 227970_at |
| Stromal-1 | NM_198580 | 376497 | SLC27A1 | solute carrier family 27 (fatty acid transporter), member 1 | 226728_at |
| Stromal-1 | NM_025106 | 80176 | SPSB1 | splA/ryanodine receptor domain and SOCS box containing 1 | 226075_at |
| Stromal-1 | NM_020130 | 56892 | C8orf4 | chromosome 8 open reading frame 4 | 218541_s_at |
| Stromal-1 | NM_173833 | 286133 | SCARA5 | scavenger receptor class A, member 5 (putative) | 229839_at |
| Stromal-1 | NM_007223 | 11245 | GPR176 | G protein-coupled receptor 176 | 227846_at |
| Stromal-1 | NM_013437 | 29967 | LRP12 | low density lipoprotein-related protein 12 | 219631_at |
| Stromal-1 | NM_007332 | 8989 | TRPA1 | transient receptor potential cation channel, subfamily A, member 1 | 228438_at |
| Stromal-1 | NM_152744 | 221935 | SDK1 | sidekick homolog 1 (chicken) | 229912_at |
| Stromal-1 | NM_001409 | 1953 | MEGF6 | multiple EGF-like-domains 6 | 226869_at |
| Stromal-1 | NM_012082 | 23414 | ZFPM2 | zinc finger protein, multitype 2 | 219778_at |
| Stromal-1 | NM_080430 | 140606 | SELM | selenoprotein M | 226051_at |
| Stromal-1 | NM_030971 | 81855 | SFXN3 | sideroflexin 3 | 217226_s_at |
| Stromal-1 | NM_003246 | 7057 | THBS1 | thrombospondin 1 | 201109_s_at |
| Stromal-1 | NM_003882 | 8840 | WISP1 | WNT1 inducible signaling pathway protein 1 | 235821_at |
| Stromal-1 | NM_005202 | 1296 | COL8A2 | collagen, type VIII, alpha 2 | 221900_at |
| Stromal-1 | NM_003711 | 8611 | PPAP2A | phosphatidic acid phosphatase type 2A | 210946_at |
| Stromal-1 | NM_004995 | 4323 | MMP14 | matrix metallopeptidase 14 (membrane-inserted) | 202828_s_at |
| Stromal-1 | NM_001005336 | 1759 | DNM_1 | dynamin 1 | 215116_s_at |
| Stromal-1 | NM_153717 | 2121 | EVC | Ellis van Creveld syndrome | 219432_at |
| Stromal-1 | NM_173462 | 89932 | PAPLN | papilin, proteoglycan-like sulfated glycoprotein | 226435_at |
| Stromal-1 | XM_496707 | 441027 | FLJ12993 | hypothetical LOC441027 | 229623_at |
| Stromal-1 | NM_001839 | 1266 | CNN3 | calponin 3, acidic | 228297_at |

TABLE 1-continued

| Signature | GenBank Accession No. | Entrez GeneID | Gene Symbol | Gene Title | Affymetrix Probe Set ID |
|---|---|---|---|---|---|
| Stromal-1 | NM_015429 | 25890 | ABI3BP | ABI gene family, member 3 (NESH) binding protein | 223395_at |
| Stromal-1 | NM_002840 | 5792 | PTPRF | protein tyrosine phosphatase, receptor type, F | 200636_s_at |
| Stromal-1 | NM_001001522 | 6876 | TAGLN | transgelin | 1555724_s_at |
| Stromal-1 | NM_017637 | 54796 | BNC2 | basonuclin 2 | 229942_at |
| Stromal-1 | NM_003391 | 7472 | WNT2 | wingless-type MMTV integration site family member 2 | 205648_at |
| Stromal-1 | NM_015461 | 25925 | ZNF521 | zinc finger protein 521 | 226677_at |
| Stromal-1 | NM_006475 | 10631 | POSTN | periostin, osteoblast specific factor | 210809_s_at |
| Stromal-1 | NM_005418 | 6764 | ST5 | suppression of tumorigenicity 5 | 202440_s_at |
| Stromal-1 | NM_005203 | 1305 | COL13A1 | collagen, type XIII, alpha 1 | 211343_s_at |
| Stromal-1 | NM_000681 | 150 | ADRA2A | adrenergic, alpha-2A-, receptor | 209869_at |
| Stromal-1 | NM_006622 | 10769 | PLK2 | polo-like kinase 2 (*Drosophila*) | 201939_at |
| Stromal-1 | AL528626 | | | Full-length cDNA clone CS0DD001YA12 of Neuroblastoma Cot 50-normalized of *Homo sapiens* (human) | 228573_at |
| Stromal-1 | AF180519 | 23766 | GABARAPL3 | GABA(A) receptors associated protein like 3 | 211458_s_at |
| Stromal-1 | NM_024723 | 79778 | MICALL2 | MICAL-like 2 | 219332_at |
| Stromal-1 | NM_057177 | 117583 | PARD3B | par-3 partitioning defective 3 homolog B (*C. elegans*) | 228411_at |
| Stromal-1 | NM_004949 | 1824 | DSC2 | desmocollin 2 | 226817_at |
| Stromal-1 | NM_032784 | 84870 | RSPO3 | R-spondin 3 homolog (*Xenopus laevis*) | 228186_at |
| Stromal-1 | NM_007039 | 11099 | PTPN21 | protein tyrosine phosphatase, non-receptor type 21 | 226380_at |
| Stromal-1 | NM_031935 | 83872 | HMCN1 | hemicentin 1 | 235944_at |
| Stromal-1 | AK022877 | | | Clone TUA8 Cri-du-ch region mRNA | 213169_at |
| Stromal-1 | AK127644 | | | CDNA FLJ45742 fis, clone KIDNE2016327 | 236297_at |
| Stromal-1 | AK056963 | | | Full length insert cDNA clone ZE03F06 | 226282_at |
| Stromal-1 | NM_000899 | 4254 | KITLG | KIT ligand | 226534_at |
| Stromal-1 | NM_002387 | 4163 | MCC | mutated in colorectal cancers | 226225_at |
| Stromal-1 | NM_198270 | 4810 | NHS | Nance-Horan syndrome (congenital cataracts and dental anomalies) | 228933_at |
| Stromal-1 | NM_183376 | 91947 | ARRDC4 | arrestin domain containing 4 | 225283_at |
| Stromal-1 | NM_000216 | 3730 | KAL1 | Kallmann syndrome 1 sequence | 205206_at |
| Stromal-1 | NM_001008224 | 55075 | UACA | uveal autoantigen with coiled-coil domains and ankyrin repeats | 223279_s_at |
| Stromal-1 | NM_133493 | 135228 | CD109 | CD109 molecule | 226545_at |
| Stromal-1 | NM_005545 | 3671 | ISLR | immunoglobulin superfamily containing leucine-rich repeat | 207191_s_at |
| Stromal-1 | NM_014365 | 26353 | HSPB8 | heat shock 22 kDa protein 8 | 221667_s_at |
| Stromal-1 | NM_014476 | 27295 | PDLIM3 | PDZ and LIM domain 3 | 209621_s_at |
| Stromal-1 | NM_020962 | 57722 | NOPE | likely ortholog of mouse neighbor of Punc E11 | 227870_at |
| Stromal-1 | NM_018357 | 55323 | LARP6 | La ribonucleoprotein domain family, member 6 | 218651_s_at |
| Stromal-1 | NM_012323 | 23764 | MAFF | v-maf musculoaponeurotic fibrosarcoma oncogene homolog F (avian) | 36711_at |
| Stromal-1 | NM_003713 | 8613 | PPAP2B | phosphatidic acid phosphatase type 2B | 212230_at |
| Stromal-1 | NM_023016 | 65124 | ANKRD57 | ankyrin repeat domain 57 | 227034_at |

TABLE 1-continued

| Signature | GenBank Accession No. | Entrez GeneID | Gene Symbol | Gene Title | Affymetrix Probe Set ID |
|---|---|---|---|---|---|
| Stromal-1 | NM_032777 | 25960 | GPR124 | G protein-coupled receptor 124 | 65718_at |
| Stromal-1 | NM_001554 | 3491 | CYR61 | cysteine-rich, angiogenic inducer, 61 | 201289_at |
| Stromal-1 | NM_145117 | 89797 | NAV2 | neuron navigator 2 | 218330_s_at |
| Stromal-1 | NM_001002292 | 79971 | GPR177 | G protein-coupled receptor 177 | 228950_s_at |
| Stromal-1 | NM_001401 | 1902 | EDG2 | endothelial differentiation, lysophosphatidic acid G-protein-coupled receptor, 2 | 204036_at |
| Stromal-1 | NM_198282 | 340061 | TMEM173 | transmembrane protein 173 | 224929_at |
| Stromal-1 | NM_014934 | 22873 | DZIP1 | DAZ interacting protein 1 | 204556_s_at |
| Stromal-1 | NM_001901 | 1490 | CTGF | connective tissue growth factor | 209101_at |
| Stromal-1 | NM_024600 | 79652 | C16orf30 | chromosome 16 open reading frame 30 | 219315_s_at |
| Stromal-1 | NM_138370 | 91461 | LOC91461 | hypothetical protein BC007901 | 225380_at |
| Stromal-1 | NM_014632 | 9645 | MICAL2 | microtubule associated monoxygenase, calponin and LIM domain containing 2 | 212472_at |
| Stromal-1 | NM_032866 | 84952 | CGNL1 | cingulin-like 1 | 225817_at |
| Stromal-1 | NM_003687 | 8572 | PDLIM4 | PDZ and LIM domain 4 | 211564_s_at |
| Stromal-1 | BM544548 | | | Transcribed locus | 236179_at |
| Stromal-1 | NM_001856 | 1307 | COL16A1 | collagen, type XVI, alpha 1 | 204345_at |
| Stromal-1 | XM_087386 | 57493 | HEG1 | HEG homolog 1 (zebrafish) | 213069_at |
| Stromal-1 | NM_003887 | 8853 | DDEF2 | development and differentiation enhancing factor 2 | 206414_s_at |
| Stromal-1 | NM_002844 | 5796 | PTPRK | protein tyrosine phosphatase, receptor type, K | 203038_at |
| Stromal-1 | NM_022138 | 64094 | SMOC2 | SPARC related modular calcium binding 2 | 223235_s_at |
| Stromal-1 | NM_001006624 | 10630 | PDPN | podoplanin | 204879_at |
| Stromal-1 | NM_003174 | 6840 | SVIL | supervillin | 202565_s_at |
| Stromal-1 | NM_002845 | 5797 | PTPRM | protein tyrosine phosphatase, receptor type, M | 1555579_s_at |
| Stromal-1 | NM_002889 | 5919 | RARRES2 | retinoic acid receptor responder (tazarotene induced) 2 | 209496_at |
| Stromal-1 | NM_006094 | 10395 | DLC1 | deleted in liver cancer 1 | 210762_s_at |
| Stromal-1 | NM_022463 | 64359 | NXN | nucleoredoxin | 219489_s_at |
| Stromal-1 | AK027294 | | | CDNA FLJ14388 fis, clone HEMBA1002716 | 229802_at |
| Stromal-1 | NM_005711 | 10085 | EDIL3 | EGF-like repeats and discoidin I-like domains 3 | 225275_at |
| Stromal-1 | NM_000177 | 2934 | GSN | gelsolin (amyloidosis, Finnish type) | 200696_s_at |
| Stromal-1 | NM_016639 | 51330 | TNFRSF12A | tumor necrosis factor receptor superfamily, member 12A | 218368_s_at |
| Stromal-1 | NM_004460 | 2191 | FAP | fibroblast activation protein, alpha | 209955_s_at |
| Stromal-1 | NM_000064 | 718 | C3 | complement component 3 | 217767_at |
| Stromal-1 | NM_016206 | 389136 | VGLL3 | vestigial like 3 (Drosophila) | 227399_at |
| Stromal-1 | NM_004339 | 754 | PTTG1IP | pituitary tumor-transforming 1 interacting protein | 200677_at |
| Stromal-1 | NM_003255 | 7077 | TIMP2 | TIMP metallopeptidase inhibitor 2 | 224560_at |
| Stromal-1 | NM_002998 | 6383 | SDC2 | syndecan 2 (heparan sulfate proteoglycan 1, cell surface-associated, fibroglycan) | 212158_at |
| Stromal-1 | NM_012223 | 4430 | MYO1B | myosin IB | 212364_at |
| Stromal-1 | NM_020650 | 57333 | RCN3 | reticulocalbin 3, EF-hand calcium binding domain | 61734_at |

TABLE 1-continued

| Signature | GenBank Accession No. | Entrez GeneID | Gene Symbol | Gene Title | Affymetrix Probe Set ID |
|---|---|---|---|---|---|
| Stromal-1 | AL573464 | | | Transcribed locus | 229554_at |
| Stromal-1 | AK001903 | | | CDNA FLJ11041 fis, clone PLACE1004405 | 227140_at |
| Stromal-1 | NM_005928 | 4240 | MFGE8 | milk fat globule-EGF factor 8 protein | 210605_s_at |
| Stromal-1 | NM_000943 | 5480 | PPIC | peptidylprolyl isomerase C (cyclophilin C) | 204518_s_at |
| Stromal-1 | NM_001008397 | 493869 | LOC493869 | similar to RIKEN cDNA 2310016C16 | 227628_at |
| Stromal-1 | AK025431 | 768211 | RELL1 | receptor expressed in lymphoid tissues like 1 | 226430_at |
| Stromal-1 | NM_000297 | 5311 | PKD2 | polycystic kidney disease 2 (autosomal dominant) | 203688_at |
| Stromal-1 | NM_002975 | 6320 | CLEC11A | C-type lectin domain family 11, member A | 211709_s_at |
| Stromal-1 | NM_001920 | 1634 | DCN | decorin | 211813_x_at |
| Stromal-1 | NM_001723 | 667 | DST | dystonin | 215016_x_at |
| Stromal-1 | CR749529 | | | MRNA; cDNA DKFZp686I18116 (from clone DKFZp686I18116) | 227554_at |
| Stromal-1 | NM_000165 | 2697 | GJA1 | gap junction protein, alpha 1, 43 kDa (connexin 43) | 201667_at |
| Stromal-1 | NM_012104 | 23621 | BACE1 | beta-site APP-cleaving enzyme 1 | 217904_s_at |
| Stromal-1 | NM_001957 | 1909 | EDNRA | endothelin receptor type A | 204464_s_at |
| Stromal-1 | NM_138455 | 115908 | CTHRC1 | collagen triple helix repeat containing 1 | 225681_at |
| Stromal-1 | NM_001331 | 1500 | CTNND1 | catenin (cadherin-associated protein), delta 1 | 208407_s_at |
| Stromal-1 | NM_001613 | 59 | ACTA2 | actin, alpha 2, smooth muscle, aorta | 200974_at |
| Stromal-1 | NM_002192 | 3624 | INHBA | inhibin, beta A (activin A, activin AB alpha polypeptide) | 210511_s_at |
| Stromal-1 | NM_000935 | 5352 | PLOD2 | procollagen-lysine, 2-oxoglutarate 5-dioxygenase 2 | 202620_s_at |
| Stromal-1 | NM_015170 | 23213 | SULF1 | sulfatase 1 | 212354_at |
| Stromal-1 | NM_006039 | 9902 | MRC2 | mannose receptor, C type 2 | 37408_at |
| Stromal-1 | NM_005261 | 2669 | GEM | GTP binding protein overexpressed in skeletal muscle | 204472_at |
| Stromal-1 | NM_001008707 | 2009 | EML1 | echinoderm microtubule associated protein like 1 | 204797_s_at |
| Stromal-1 | NM_001031679 | 253827 | MSRB3 | methionine sulfoxide reductase B3 | 225782_at |
| Stromal-1 | NM_001004125 | 286319 | TUSC1 | tumor suppressor candidate 1 | 227388_at |
| Stromal-1 | NM_005965 | 4638 | MYLK | myosin, light chain kinase | 202555_s_at |
| Stromal-1 | NM_016205 | 56034 | PDGFC | platelet derived growth factor C | 218718_at |
| Stromal-1 | NM_015976 | 51375 | SNX7 | sorting nexin 7 | 205573_s_at |
| Stromal-1 | NM_130830 | 131578 | LRRC15 | leucine rich repeat containing 15 | 213909_at |
| Stromal-1 | NM_002026 | 2335 | FN1 | fibronectin 1 | 212464_s_at |
| Stromal-1 | NM_006855 | 11015 | KDELR3 | KDEL (Lys-Asp-Glu-Leu) endoplasmic reticulum protein retention receptor 3 | 204017_at |
| Stromal-1 | NM_002292 | 3913 | LAMB2 | laminin, beta 2 (laminin S) | 216264_s_at |
| Stromal-1 | NM_002658 | 5328 | PLAU | plasminogen activator, urokinase | 205479_s_at |
| Stromal-1 | NM_005529 | 3339 | HSPG2 | heparan sulfate proteoglycan 2 (perlecan) | 201655_s_at |
| Stromal-1 | NM_001235 | 871 | SERPINH1 | serpin peptidase inhibitor, clade H (heat shock protein 47), member 1, (collagen binding protein 1) | 207714_s_at |
| Stromal-1 | AJ318805 | | | CDNA FLJ44429 fis, clone UTERU2015653 | 227061_at |

TABLE 1-continued

| Signature | GenBank Accession No. | Entrez GeneID | Gene Symbol | Gene Title | Affymetrix Probe Set ID |
|---|---|---|---|---|---|
| Stromal-1 | NM_000396 | 1513 | CTSK | cathepsin K | 202450_s_at |
| Stromal-1 | NM_031302 | 83468 | GLT8D2 | glycosyltransferase 8 domain containing 2 | 227070_at |
| Stromal-1 | NM_080821 | 116151 | C20orf108 | chromosome 20 open reading frame 108 | 224690_at |
| Stromal-1 | NM_002345 | 4060 | LUM | lumican | 201744_s_at |
| Stromal-1 | NM_005110 | 9945 | GFPT2 | glutamine-fructose-6-phosphate transaminase 2 | 205100_at |
| Stromal-1 | NM_002941 | 6091 | ROBO1 | roundabout, axon guidance receptor, homolog 1 (Drosophila) | 213194_at |
| Stromal-1 | NM_005429 | 7424 | VEGFC | vascular endothelial growth factor C | 209946_at |
| Stromal-1 | NM_002213 | 3693 | ITGB5 | integrin, beta 5 | 201125_s_at |
| Stromal-1 | XM_051017 | 23363 | OBSL1 | obscurin-like 1 | 212775_at |
| Stromal-1 | NM_181724 | 338773 | TMEM119 | transmembrane protein 119 | 227300_at |
| Stromal-1 | NM_003474 | 8038 | ADAM12 | ADAM metallopeptidase domain 12 (meltrin alpha) | 213790_at |
| Stromal-1 | NM_018222 | 55742 | PARVA | parvin, alpha | 217890_s_at |
| Stromal-1 | NM_006478 | 10634 | GAS2L1 | growth arrest-specific 2 like 1 | 31874_at |
| Stromal-1 | NM_000093 | 1289 | COL5A1 | collagen, type V, alpha 1 | 212489_at |
| Stromal-1 | NM_006288 | 7070 | THY1 | Thy-1 cell surface antigen | 208851_s_at |
| Stromal-1 | CD357685 | | TIMP2 | Transcribed locus, strongly similar to XP_511714.1 similar to Metalloproteinase inhibitor 2 precursor (TIMP-2) (Tissue inhibitor of metalloproteinases-2) (CSC-21K) [Pan troglodytes] | 231579_s_at |
| Stromal-1 | NM_003247 | 7058 | THBS2 | thrombospondin 2 | 203083_at |
| Stromal-1 | NM_000088 | 1277 | COL1A1 | collagen, type I, alpha 1 | 1556499_s_at |
| Stromal-1 | NM_006832 | 10979 | PLEKHC1 | pleckstrin homology domain containing, family C (with FERM domain) member 1 | 209210_s_at |
| Stromal-1 | NM_021961 | 7003 | TEAD1 | TEA domain family member 1 (SV40 transcriptional enhancer factor) | 224955_at |
| Stromal-1 | AK128814 | | | CDNA FLJ25106 fis, clone CBR01467 | 213675_at |
| Stromal-1 | NM_153367 | 219654 | C10orf56 | chromosome 10 open reading frame 56 | 212423_at |
| Stromal-1 | AK092048 | | | MRNA; cDNA DKFZp313C0240 (from clone DKFZp313C0240) | 227623_at |
| Stromal-1 | NM_005245 | 2195 | FAT | FAT tumor suppressor homolog 1 (Drosophila) | 201579_at |
| Stromal-1 | NM_001129 | 165 | AEBP1 | AE binding protein 1 | 201792_at |
| Stromal-1 | NM_002403 | 4237 | MFAP2 | microfibrillar-associated protein 2 | 203417_at |
| Stromal-1 | NM_004342 | 800 | CALD1 | caldesmon 1 | 201616_s_at |
| Stromal-1 | NM_005576 | 4016 | LOXL1 | lysyl oxidase-like 1 | 203570_at |
| Stromal-1 | NM_199511 | 151887 | CCDC80 | coiled-coil domain containing 80 | 225242_s_at |
| Stromal-1 | NM_012098 | 23452 | ANGPTL2 | angiopoietin-like 2 | 213001_at |
| Stromal-1 | NM_002210 | 3685 | ITGAV | integrin, alpha V (vitronectin receptor, alpha polypeptide, antigen CD51) | 202351_at |
| Stromal-1 | NM_000366 | 7168 | TPM1 | tropomyosin 1 (alpha) | 210986_at |
| Stromal-1 | NM_198474 | 283298 | OLFML1 | olfactomedin-like 1 | 217525_at |
| Stromal-1 | NM_001424 | 2013 | EMP2 | epithelial membrane protein 2 | 225078_at |
| Stromal-1 | NM_032575 | 84662 | GLIS2 | GLIS family zinc finger 2 | 223378_at |
| Stromal-1 | NM_007173 | 11098 | PRSS23 | protease, serine, 23 | 226279_at |
| Stromal-1 | NM_001015880 | 9060 | PAPSS2 | 3'-phosphoadenosine 5'-phosphosulfate synthase 2 | 203060_s_at |
| Stromal-1 | NM_015645 | 114902 | C1QTNF5 | C1q and tumor necrosis factor related protein 5 | 223499_at |

TABLE 1-continued

| Signature | GenBank Accession No. | Entrez GeneID | Gene Symbol | Gene Title | Affymetrix Probe Set ID |
|---|---|---|---|---|---|
| Stromal-1 | AK130049 | | | CDNA FLJ26539 fis, clone KDN09310 | 213429_at |
| Stromal-1 | NM_001849 | 1292 | COL6A2 | collagen, type VI, alpha 2 | 209156_s_at |
| Stromal-1 | NM_001014796 | 4921 | DDR2 | discoidin domain receptor family, member 2 | 225442_at |
| Stromal-1 | NM_015463 | 25927 | C2orf32 | chromosome 2 open reading frame 32 | 226751_at |
| Stromal-1 | AK055628 | | ADAM12 | CDNA FLJ31066 fis, clone HSYRA2001153 | 226777_at |
| Stromal-1 | NM_014799 | 9843 | HEPH | hephaestin | 203903_s_at |
| Stromal-1 | NM_004385 | 1462 | CSPG2 | chondroitin sulfate proteoglycan 2 (versican) | 221731_x_at |
| Stromal-1 | NM_152330 | 122786 | FRMD6 | FERM domain containing 6 | 225481_at |
| Stromal-1 | BQ917964 | | PPP4R2 | Transcribed locus | 235733_at |
| Stromal-1 | NM_002615 | 5176 | SERPINF1 | serpin peptidase inhibitor, clade F (alpha-2 antiplasmin, pigment epithelium derived factor), member 1 | 202283_at |
| Stromal-1 | NM_032348 | 54587 | MXRA8 | matrix-remodelling associated 8 | 213422_s_at |
| Stromal-1 | NM_006106 | 10413 | YAP1 | Yes-associated protein 1, 65 kDa | 224894_at |
| Stromal-1 | NM_020182 | 56937 | TMEPAI | transmembrane, prostate androgen induced RNA | 222449_at |
| Stromal-1 | CB999028 | | | Transcribed locus | 226834_at |
| Stromal-1 | NM_001711 | 633 | BGN | biglycan | 201261_x_at |
| Stromal-1 | NM_006902 | 5396 | PRRX1 | paired related homeobox 1 | 226695_at |
| Stromal-1 | NM_000428 | 4053 | LTBP2 | latent transforming growth factor beta binding protein 2 | 204682_at |
| Stromal-1 | NM_004369 | 1293 | COL6A3 | collagen, type VI, alpha 3 | 201438_at |
| Stromal-1 | NM_000393 | 1290 | COL5A2 | collagen, type V, alpha 2 | 221730_at |
| Stromal-1 | NM_015419 | 25878 | MXRA5 | matrix-remodelling associated 5 | 209596_at |
| Stromal-1 | NM_001102 | 87 | ACTN1 | actinin, alpha 1 | 208637_x_at |
| Stromal-1 | NM_000877 | 3554 | IL1R1 | interleukin 1 receptor, type I | 202948_at |
| Stromal-1 | NM_015927 | 7041 | TGFB1I1 | transforming growth factor beta 1 induced transcript 1 | 209651_at |
| Stromal-1 | NM_032772 | 84858 | ZNF503 | zinc finger protein 503 | 227195_at |
| Stromal-1 | NM_020440 | 5738 | PTGFRN | prostaglandin F2 receptor negative regulator | 224937_at |
| Stromal-1 | NM_000138 | 2200 | FBN1 | fibrillin 1 | 202765_s_at |
| Stromal-1 | NM_031442 | 83604 | TMEM47 | transmembrane protein 47 | 209656_s_at |
| Stromal-1 | NM_001734 | 716 | C1S | complement component 1, s subcomponent | 208747_s_at |
| Stromal-1 | NM_002290 | 3910 | LAMA4 | laminin, alpha 4 | 202202_s_at |
| Stromal-1 | CN312045 | | PPP4R2 | Transcribed locus, weakly similar to NP_001013658.1 protein LOC6387873 [*Homo sapiens*] | 222288_at |
| Stromal-1 | NM_000089 | 1278 | COL1A2 | collagen, type I, alpha 2 | 202403_s_at |
| Stromal-1 | NM_004530 | 4313 | MMP2 | matrix metallopeptidase 2 (gelatinase A, 72 kDa gelatinase, 72 kDa type IV collagenase) | 201069_at |
| Stromal-1 | NM_001387 | 1809 | DPYSL3 | dihydropyrimidinase-like 3 | 201431_s_at |
| Stromal-1 | NM_138389 | 92689 | FAM114A1 | family with sequence similarity 114, member A1 | 213455_at |
| Stromal-1 | NM_006670 | 7162 | TPBG | trophoblast glycoprotein | 203476_at |
| Stromal-1 | NM_000304 | 5376 | PMP22 | peripheral myelin protein 22 | 210139_s_at |
| Stromal-1 | NM_002775 | 5654 | HTRA1 | HtrA serine peptidase 1 | 201185_at |
| Stromal-1 | NM_002593 | 5118 | PCOLCE | procollagen C-endopeptidase enhancer | 202465_at |
| Stromal-1 | NM_003118 | 6678 | SPARC | secreted protein, acidic, cysteine-rich (osteonectin) | 212667_at |

TABLE 1-continued

| Signature | GenBank Accession No. | Entrez GeneID | Gene Symbol | Gene Title | Affymetrix Probe Set ID |
|---|---|---|---|---|---|
| Stromal-1 | NM_007085 | 11167 | FSTL1 | follistatin-like 1 | 208782_at |
| Stromal-1 | NM_001080393 | 727936 | | predicted glycosyl-transferase 8 domain containing 4 | 235371_at |
| Stromal-1 | NM_018153 | 84168 | ANTXR1 | anthrax toxin receptor 1 | 224694_at |
| Stromal-1 | NM_001733 | 715 | C1R | complement component 1, r subcomponent | 212067_s_at |
| Stromal-1 | NM_001797 | 1009 | CDH11 | cadherin 11, type 2, OB-cadherin (osteoblast) | 207173_x_at |
| Stromal-1 | NM_016938 | 30008 | EFEMP2 | EGF-containing fibulin-like extracellular matrix protein 2 | 209356_x_at |
| Stromal-2 | NM_014601 | 30846 | EHD2 | EH-domain containing 2 | 45297_at |
| Stromal-2 | NM_017789 | 54910 | SEMA4C | sema domain, immunoglobulin domain (Ig), transmembrane domain (TM) and short cytoplasmic domain, semaphorin 4C | 46665_at |
| Stromal-2 | NM_000484 | 351 | APP | amyloid beta (A4) precursor protein (peptidase nexin-II, Alzheimer disease) | 200602_at |
| Stromal-2 | NM_004684 | 8404 | SPARCL1 | SPARC-like 1 (mast9, hevin) | 200795_at |
| Stromal-2 | NM_002291 | 3912 | LAMB1 | laminin, beta 1 | 201505_at |
| Stromal-2 | NM_000210 | 3655 | ITGA6 | integrin, alpha 6 | 201656_at |
| Stromal-2 | NM_000552 | 7450 | VWF | von Willebrand factor | 202112_at |
| Stromal-2 | NM_001233 | 858 | CAV2 | caveolin 2 | 203323_at |
| Stromal-2 | NM_006404 | 10544 | PROCR | protein C receptor, endothelial (EPCR) | 203650_at |
| Stromal-2 | NM_000609 | 6387 | CXCL12 | chemokine (C-X-C motif) ligand 12 (stromal cell-derived factor 1) | 203666_at |
| Stromal-2 | NM_002253 | 3791 | KDR | kinase insert domain receptor (a type III receptor tyrosine kinase) | 203934_at |
| Stromal-2 | NM_001442 | 2167 | FABP4 | fatty acid binding protein 4, adipocyte | 203980_at |
| Stromal-2 | NM_016315 | 51454 | GULP1 | GULP, engulfment adaptor PTB domain containing 1 | 204237_at |
| Stromal-2 | NM_006307 | 8406 | SRPX | sushi-repeat-containing protein, X-linked | 204955_at |
| Stromal-2 | NM_000163 | 2690 | GHR | growth hormone receptor | 205498_at |
| Stromal-2 | NM_000950 | 5638 | PRRG1 | proline rich Gla (G-carboxyglutamic acid) 1 | 205618_at |
| Stromal-2 | NM_002666 | 5346 | PLIN | perilipin | 205913_at |
| Stromal-2 | NM_000459 | 7010 | TEK | TEK tyrosine kinase, endothelial (venous malformations, multiple cutaneous and mucosal) | 206702_at |
| Stromal-2 | NM_004797 | 9370 | ADIPOQ | adiponectin, C1Q and collagen domain containing | 207175_at |
| Stromal-2 | NM_000442 | 5175 | PECAM1 | platelet/endothelial cell adhesion molecule (CD31 antigen) | 208981_at |
| Stromal-2 | NM_198098 | 358 | AQP1 | aquaporin 1 (Colton blood group) | 209047_at |
| Stromal-2 | NM_021005 | 7026 | NR2F2 | nuclear receptor subfamily 2, group F, member 2 | 209120_at |
| Stromal-2 | NM_014220 | 4071 | TM4SF1 | transmembrane 4 L six family member 1 | 209386_at |
| Stromal-2 | NM_001001549 | 2887 | GRB10 | growth factor receptor-bound protein 10 | 209409_at |
| Stromal-2 | NM_006108 | 10418 | SPON1 | spondin 1, extracellular matrix protein | 209436_at |
| Stromal-2 | NM_001003679 | 3953 | LEPR | leptin receptor | 209894_at |
| Stromal-2 | NM_000599 | 3488 | IGFBP5 | insulin-like growth factor binding protein 5 | 211959_at |
| Stromal-2 | NM_001753 | 857 | CAV1 | caveolin 1, caveolae protein, 22 kDa | 212097_at |
| Stromal-2 | NM_005841 | 10252 | SPRY1 | sprouty homolog 1, antagonist of FGF signaling (*Drosophila*) | 212558_at |

TABLE 1-continued

| Signature | GenBank Accession No. | Entrez GeneID | Gene Symbol | Gene Title | Affymetrix Probe Set ID |
|---|---|---|---|---|---|
| Stromal-2 | NM_015345 | 23500 | DAAM2 | dishevelled associated activator of morphogenesis 2 | 212793_at |
| Stromal-2 | NM_015234 | 221395 | GPR116 | G protein-coupled receptor 116 | 212950_at |
| Stromal-2 | NM_006108 | 10418 | SPON1 | spondin 1, extracellular matrix protein | 213993_at |
| Stromal-2 | NM_016215 | 51162 | EGFL7 | EGF-like-domain, multiple 7 | 218825_at |
| Stromal-2 | NM_022481 | 64411 | CENTD3 | centaurin, delta 3 | 218950_at |
| Stromal-2 | XM_371262 | 64123 | ELTD1 | EGF, latrophilin and seven transmembrane domain containing 1 | 219134_at |
| Stromal-2 | NM_016563 | 51285 | RASL12 | RAS-like, family 12 | 219167_at |
| Stromal-2 | NM_006094 | 10395 | DLC1 | deleted in liver cancer | 224822_at |
| Stromal-2 | NM_019035 | 54510 | PCDH18 | protocadherin 18 | 225975_at |
| Stromal-2 | NM_019055 | 54538 | ROBO4 | roundabout homolog 4, magic roundabout (*Drosophila*) | 226028_at |
| Stromal-2 | NM_002207 | 3680 | ITGA9 | integrin, alpha 9 | 227297_at |
| Stromal-2 | XM_930608 | 641700 | ECSM2 | endothelial cell-specific molecule 2 | 227779_at |
| Stromal-2 | XM_037493 | 85358 | SHANK3 | SH3 and multiple ankyrin repeat domains 3 | 227923_at |
| Stromal-2 | NM_052954 | 116159 | CYYR1 | cysteine/tyrosine-rich 1 | 228665_at |
| Stromal-2 | NM_002837 | 5787 | PTPRB | protein tyrosine phosphatase, receptor type, B | 230250_at |
| Stromal-2 | NM_019558 | 3234 | HOXD8 | homeobox D8 | 231906_at |
| Stromal-2 | NM_001442 | 2167 | FABP4 | fatty acid binding protein 4, adipocyte | 235978_at |
| Stromal-2 | NM_024756 | 79812 | MMRN2 | multimerin 2 | 236262_at |
| Stromal-2 | BQ897248 | | | Transcribed locus | 242680_at |
| Stromal-2 | NM_020663 | 57381 | RHOJ | ras homolog gene family, member J | 243481_at |
| Stromal-2 | AK091419 | | | CDNA FLJ34100 fis, clone FCBBF3007597 | 1558397_at |
| Stromal-2 | NM_015719 | 50509 | COL5A3 | collagen, type V, alpha 3 | 52255_s_at |
| Stromal-2 | NM_012072 | 22918 | CD93 | CD93 molecule | 202878_s_at |
| Stromal-2 | NM_000300 | 5320 | PLA2G2A | phospholipase A2, group IIA (platelets, synovial fluid) | 203649_s_at |
| Stromal-2 | NM_019105 | 7148 | TNXB | tenascin XB | 206093_x_at |
| Stromal-2 | NM_030754 | 6289 | SAA2 | serum amyloid A2 | 208607_s_at |
| Stromal-2 | NM_019105 | 7148 | TNXB | tenascin XB | 208609_s_at |
| Stromal-2 | NM_014220 | 4071 | TM4SF1 | transmembrane 4 L six family member 1 | 209387_s_at |
| Stromal-2 | NM_000668 | 125 | ADH1B | alcohol dehydrogenase IB (class I), beta polypeptide | 209612_s_at |
| Stromal-2 | NM_000668 | 125 | ADH1B | alcohol dehydrogenase IB (class I), beta polypeptide | 209613_s_at |
| Stromal-2 | NM_001354 | 1646 | AKR1C2 | aldo-keto reductase family 1, member C2 (dihydrodiol dehydrogenase 2; bile acid binding protein; 3-alpha hydroxysteroid dehydrogenase, type III) | 209699_x_at |
| Stromal-2 | NM_001032281 | 7035 | TFPI | tissue factor pathway inhibitor (lipoprotein-associated coagulation inhibitor) | 210664_s_at |
| Stromal-2 | NM_001001924 | 57509 | MTUS1 | mitochondrial tumor suppressor 1 | 212096_s_at |
| Stromal-2 | NM_019105 | 7148 | TNXB | tenascin XB | 213451_x_at |
| Stromal-2 | NM_004449 | 2078 | ERG | v-ets erythroblastosis virus E26 oncogene homolog (avian) | 213541_s_at |
| Stromal-2 | NM_018407 | 55353 | LAPTM4B | lysosomal associated protein transmembrane 4 beta | 214039_s_at |
| Stromal-2 | NM_000331 | 6288 | SAA1 | serum amyloid A1 | 214456_x_at |
| Stromal-2 | NM_019105 | 7148 | TNXB | tenascin XB | 216333_x_at |
| Stromal-2 | NM_001034954 | 10580 | SORBS1 | sorbin and SH3 domain containing 1 | 218087_s_at |
| Stromal-2 | NM_017734 | 54873 | PALMD | palmdelphin | 218736_s_at |
| Stromal-2 | NM_024756 | 79812 | MMRN2 | multimerin 2 | 219091_s_at |

TABLE 1-continued

| Signature | GenBank Accession No. | Entrez GeneID | Gene Symbol | Gene Title | Affymetrix Probe Set ID |
|---|---|---|---|---|---|
| Stromal-2 | NM_006744 | 5950 | RBP4 | retinol binding protein 4, plasma | 219140_s_at |
| Stromal-2 | NM_001034954 | 10580 | SORBS1 | sorbin and SH3 domain containing 1 | 222513_s_at |

The DLBCL survival predictors of the invention were generated using expression data and methods described in Examples 1 and 2, below. The first bivariate survival predictor incorporates the GCB and stromal-1 gene expression signatures. Fitting the Cox proportional hazards model to the gene expression data obtained from these two signatures resulted in a bivariate model survival predictor score calculated using the following generalized equation:

Bivariate DLBCL survival predictor score=$A-[(x)*$(GCB signature value)]$-[(y)*$(stromal-1 signature value)].

In this equation, A is an offset term, while (x) and (y) are scale factors. The GCB signature value and the stromal-1 signature value can correspond to the average of the expression levels of all genes in the GCB signature and the stromal-1 signature, respectively. A lower survival predictor score indicates a more favorable survival outcome, and a higher survival predictor score indicates a less favorable survival outcome for the subject.

The bivariate survival predictor was refined into a multivariate survival predictor that incorporates GCB, stromal-1, and stromal-2 gene expression signatures. Fitting the Cox proportional hazards model to the gene expression data obtained from these three signatures resulted in a multivariate model survival predictor score calculated using the following generalized equation:

General multivariate DLBCL survival predictor score=$A-[(x)*$(GCB signature value)]$-[(y)*$(stromal-1 signature value)]$+[(z)*$(stromal-2 signature value)].

In this equation, A is an offset term, while (x), (y), and (z) are scale factors. The GCB signature value, the stromal-1 signature value, and the stromal-2 signature value can correspond to the average of the expression levels of all genes in the GCB signature, the stromal-1 signature, and the stromal-2 signature, respectively. A lower survival predictor score indicates a more favorable survival outcome and a higher survival predictor score indicates a less favorable survival outcome for the subject.

In one embodiment, the invention provides the following multivariate survival predictor equation:

Multivariate DLBCL survival predictor score=8.11$-$[0.419*(GCB signature value)]$-$[1.015*(stromal-1 signature value)]$+$[0.675*(stromal-2 signature value)]

In this equation, a lower survival predictor score indicates a more favorable survival outcome, and a higher survival predictor score indicates a poorer survival outcome for the subject.

In other embodiments of the multivariate DLBCL survival predictor score equation, the offset term (A) or (8.11) can be varied without affecting the equation's usefulness in predicting clinical outcome. Scale factors (x), (y), and (z) can also be varied, individually or in combination. For example, scale factor (x) can be from about 0.200 or more, from about 0.225 or more, from about 0.250 or more, from about 0.275 or more, from about 0.300, from about 0.325 or more, from about 0.350 or more, from about 0.375 or more, or from about 0.400 or more. Alternatively, or in addition, scale factor (x) can be about 0.625 or less, about 0.600 or less, about 0.575 or less, about 0.550 or less, about 0.525 or less, about 0.500 or less, about 0.475 or less, about 0.450 or less, or about 0.425 or less. Thus, scale factor (z) can be one that is bounded by any two of the previous endpoints. For example scale factor (x) can be a value from 0.200-0.625, from 0.350-0.550, from 0.350-0.475, or from 0.400-0.425. Similarly, scale factor (y) can be from about 0.800 or more, from about 0.825 or more, from about 0.850 or more, from about 0.875 or more, from about 0.900 or more, from about 0.925 or more, from about 0.950 or more, from about 0.975 or more, or from about 1.000 or more. Alternatively, or in addition, scale factor (y) can be, e.g., about 1.250 or less, e.g., about 1.225 or less, about 1.200, about 1.175 or less, about 1.150 or less, about 1.125 or less, about 1.100 or less, about 1.075 or less, about 1.050 or less, or about 1.025 or less. Thus, scale factor (y) can be one that is bounded by any two of the previous endpoints. For example, scale factor (y) can be a value from 0.800-1.250, a value from 0.950-1.1025, a value from 0.950-1.200 or a value from 1.000-1.025. Also similarly, scale factor (z) can be from about 0.450 or more, about 0.475 or more, about 0.500 or more, about 0.525 or more, about 0.550 or more, about 0.575 or more, about 0.600 or more, about 0.625 or more, or about 0.650 or more. Alternatively, or in addition, scale factor (z) can be, e.g., about 0.900 or less, e.g., about 0.875 or less, about 0.850, about 0.825 or less, about 0.800 or less, about 0.775 or less, about 0.750 or less, or about 0.725 or less. Thus, scale factor (z) can be one that is bounded by any two of the previous endpoints. For example, scale factor (z) can be a value from 0.450-0.900, any value from 0.650-0.725, any value from 0.625-0.775 or any value from 0.650-0.700.

Furthermore, the invention includes any set of scale factors (x), (y), and (z) in conjunction in the general multivariate DLBCL survival predictor score that creates a function that is monotonically related to a multivariate DLBCL survival predictor score equation using any combination of the foregoing specified scale factor (x), (y), and (z) values.

In some embodiments of the invention, a survival predictor score can be calculated using fewer than all of the gene components of the GCB signature, the stromal-1 signature, and/or the stromal-2 signature listed in Table 1. For example, the survival prediction equations disclosed herein can be calculated using mathematical combinations of the expressions of 98% (38), 95% (37), 93% (36), or 90% (35) of the genes listed in Table 1 for the GCB signature, about 99% (about 280), about 98% (about 277), 97% (about 275), about 96% (about 272), about 95% (about 270), about 94% (about 266), about 93% (about 263), about 92% (about 260), about 91% (about 257), or about 90% (about 255) of the genes listed in Table 1 for the stromal-1 signature, and/or 99% (71), 97% (70), 96% (69), 95% (68) 93% (67), 92% (66), or 90% (65) of the genes listed in Table 1 for the stromal-2 signature (instead of using all of the genes corresponding to a gene signature in Table 1 to calculate the GCB signature value, the stromal-1 signature value, and/or stromal-2 signature value, respectively). In other embodiments, the survival prediction equations disclosed herein can be calculated using mathematical combinations of the expressions of 88% (34 genes), 85% (33 genes), 82% (32 genes), 80% (31 genes) of the genes listed in Table 1 for the GCB signature, about 89% (about 252), about 88% (about 249), about 87% (about 246), about 86% (about 243), about 85% (about 241), about 84% (about 238), about 83% (about 235), about 82% (about 232), about 81% (about 229), or about 80% (about 226) of the genes listed in Table 1 for the stromal-1 signature, and/or 89% (64), 88% (63), 86% (62), 85% (61), 83% (60), 82% (59) or 80% (58) of the genes listed in Table 1 for the stromal-2 signature (instead of using all of the genes corresponding to a gene signature in Table 1 to calculate the GCB signature value, the stromal-1 signature value, and/or stromal-2 signature value, respectively).

The invention also provides a method of using a DLBCL survival predictor score to predict the probability of a survival outcome beyond an amount of time t following treatment for DLBCL. The method includes calculating the probability of a survival outcome for a subject using the following general equation:

$$P(SO)=SO_0(t)^{(exp((s)*(survival\ predictor\ score)))}$$

In this equation, P(SO) is the subject's probability of the survival outcome beyond time t following treatment for DLBCL, $SO_0(t)$ is the probability of survival outcome, which corresponds to the largest time value smaller than t in a survival outcome curve, and (s) is a scale factor. Treatment for DLBCL can include chemotherapy and the administration of Rituximab. A survival curve can be calculated using statistical methods, such as the Cox Proportional Hazard Model. Additional information regarding survival outcome curves is set forth in Lawless, *Statistical Models and Methods for Lifetime Data*, John Wiley and Sons (New York 1982) and Kalbfleisch et al., *Biometrika*, 60: 267-79 (1973).

In one embodiment, the method of the invention includes calculating the probability of overall survival for a subject beyond an amount of time t following treatment for DLBCL. The method includes calculating the probability of a survival outcome for a subject using the following general equation:

$$P(OS)=SO_0(t)^{(exp(survival\ predictor\ score))}$$

In the equation, P(OS) is the subject's probability of overall survival beyond time t following treatment for DLBCL, $SO_0(t)$ is the curve probability of survival outcome, which corresponds to the largest time value in a survival curve which is smaller than t, and the general equation scale factor (s)=1. Treatment for DLBCL can include chemotherapy alone or in combination with the administration of Rituximab (R-CHOP).

In another embodiment, the method of the invention includes calculating the probability of progression-free survival for a subject beyond an amount of time t following treatment for DLBCL. The method includes calculating the probability of a survival outcome for a subject using the following general equation:

$$P(PFS)=SO_0(t)^{(exp(0.976*(survival\ predictor\ score)))}$$

In this equation, P(PFS) is the subject's probability of progression-free survival beyond time t following treatment for DLBCL, $SO_0(t)$ is the curve probability of progression-free survival, which corresponds to the largest time value in a survival curve which is smaller than t, and the general equation scale factor (s)=0.976. The treatment for DLBCL can include chemotherapy alone or in combination with the administration of Rituximab (R-CHOP).

The foregoing equations for P(OS) and P(PFS) were generated by maximizing the partial likelihoods of the Cox proportional hazards model within the LLMPP CHOP data described below in Examples 1 and 2. Separate single variable Cox proportional hazards models were considered for overall survival P(OS) and for progression free survival P(PFS) based on this model score formulation. The single variable scale factor (1.0 for overall survival and 0.997 for progression free survival) were generated for each model by maximization of the partial likelihoods within the R-CHOP patients described below in Examples 1 and 2.

In other embodiments, the scale factor in the foregoing P(PFS) can be varied such that (instead of 0.976) scale factor (s) is a value between 0.970 and 0.980, e.g. 0.971, 0.972, 0.973, 0.973, 0.974, 0.975, 0.977, 0.978, and 0.979.

The invention also provides a method of selecting a subject for antiangiogenic therapy of DLBCL based on the subject's high relative expression of stromal-2 signature genes. As discussed more fully below in Example 4, the stromal-2 signature includes a number of genes whose expression or gene products are related to angiogenesis. Thus, high relative expression of stromal-2 signature genes in DLBCL can be indicative of high angiogenic activity. Moreover, high relative expression of stromal-2 signature genes can be related to the heavy infiltration of some DLBCL tumors with myeloid lineage cells. Accordingly, subjects with high relative expression of stromal-2 signature genes are good candidates for treatment with antiangiogenic therapy, either alone or in combination with other anti-oncogenic therapies. Furthermore, as also discussed more fully in Example 4, a stromal score, which was obtained by subtracting the stromal-1 signature value from the stromal-2 signature value, was observed to correlate with high tumor blood vessel density.

In this regard, the antiangiogenic monoclonal antibody to vascular endothelial growth factor bevacizumab has been clinically tested in patients with DLBCL (Ganjoo et al., *Leuk. Lymphoma*, 47: 998-1005 (2006)). Other antiangiogenic therapies can include small molecule inhibitors of SDF-1 receptor, such as CXCR4 (Petit et al., *Trends Immunol.*, 28: 299-307 (2007). Still another example of an antiangiogenic therapy can include blocking antibodies to the myeloid lineage cell marker CTGF, which has been implicated in angiogenesis. Moreover, anti-CTGF antibodies have been shown to have anti-cancer activity in pre-clinical models of cancer (Aikawa et al., *Mol. Cancer Ther.*, 5: 1108-16 (2006)).

In one embodiment, the method of the invention for selecting a subject for antiangiogenic therapy includes obtaining a gene expression profile from a DLBCL biopsy from the subject. The subject's stromal-2 signature value is determined. The subject's stromal-2 signature value is then compared to a standard stromal-2 value. A standard stromal-2 value corresponds to the average of multiple stromal-2 signature values in DLBCL biopsy samples from a plurality of randomly selected subjects with DLBCL, e.g., more than 10, 20, 30, 40, 50, 60, 70, 80, 90, 100, 150, 200, or 250 randomly selected subjects with DLBCL. If the subject's stromal-2 signature value is significantly higher than the standard stromal-2 value, then the subject can be treated with anti-angiogenic therapy.

In another embodiment, the method of the invention for selecting a subject for anti-angiogenic therapy includes obtaining a gene expression profile from a DLBCL biopsy from the subject. The subject's stromal 1 signature value and stromal-2 signature value are determined. The stromal-1 signature value is then subtracted from the stromal-2 signature value to obtain a stromal score. The subject's stromal score is then compared to a standard stromal score. A standard stromal score corresponds to the average of multiple stromal scores (each stromal score=[stromal-2 signature value])–[stromal-1 signature value]) derived from DLBCL biopsy samples from a plurality of randomly selected subjects with DLBCL, e.g., more than 10, 20, 30, 40, 50, 60, 70, 80, 90, 100, 150, 200, or 250 randomly selected subjects with DLBCL. If the subject's stromal score is significantly higher than the standard stromal score, then the subject can be treated with anti-angiogenic therapy.

The invention further provides a targeted array that can be used to detect the expression levels of all or most of the genes in a germinal center B cell gene (GCB) expression signature, a stromal-1 gene expression signature, and/or a stromal-2 gene expression signature. A targeted array, as used herein, is an array directed to a limited set of genes and thus differs from a whole genome array. The targeted array of the invention can include probes for fewer than 20,000 genes, fewer than 15,000 genes, fewer than 10,000 genes, fewer than 8,000 genes, fewer than 7,000 genes, fewer than 6,000 genes, fewer than 5,000 genes, or fewer than 4,000 genes. Generally, the targeted array includes probes for at least 80% of the genes in a germinal center B cell gene (GCB) expression signature, a stromal-1 gene expression signature, and/or a stromal-2 gene expression signature. The targeted arrays of the invention can be used, for example, to detect expression levels for use in the methods described herein.

The invention provides a targeted array that includes probes for all of the genes in the stromal-1 gene expression signature. The invention also provides a targeted array that includes probes for all of the genes in the stromal-2 gene expression signature. Additionally, the invention provides a targeted array that includes probes for all of the genes in the stromal-1 gene expression signature and all of the genes in the stromal-2 gene expression signature. Moreover, the invention provides a targeted array that includes probes for all of the genes, in the stromal-1 gene expression signature, all of the genes in the stromal-2 gene expression signature, and all of the genes in the GCB signature.

In certain embodiments, the arrays of the invention can include 98% (38), 95% (37), 93% (36), or 90% (35) of the genes listed in Table 1 for the GCB signature, about 99% (about 280), about 98% (about 277), 97% (about 275), about 96% (about 272), about 95% (about 270), about 94% (about 266), about 93% (about 263), about 92% (about 260), about 91% (about 257), or about 90% (about 255) of the genes listed in Table 1 for the stromal-1 signature, and/or 99% (71), 97% (70), 96% (69), 95% (68) 93% (67), 92% (66), or 90% (65) of the genes listed in Table 1 for the stromal-2 signature (instead of all of the genes listed in Table 1 for the GCB signature average, the stromal-1 signature average, and/or stromal-2 signature average, respectively). In certain embodiments, the arrays of the invention can include 88% (34 genes), 85% (33 genes), 82% (32 genes), 80% (31 genes) of the genes listed in Table 1 for the GCB signature, about 89% (about 252), about 88% (about 249), about 87% (about 246), about 86% (about 243), about 85% (about 241), about 84% (about 238), about 83% (about 235), about 82% (about 232), about 81% (about 229), or about 80% (about 226) of the genes listed in Table 1 for the stromal-1 signature, and/or 89% (64), 88% (63), 86% (62), 85% (61), 83% (60), 82% (59) or 80% (58) of the genes listed in Table 1 for the stromal-2 signature (instead of all of the genes listed in Table 1 for the GCB signature average, the stromal-1 signature average, and/or stromal-2 signature average, respectively).

The following examples further illustrate the invention but, of course, should not be construed as in any way limiting its scope.

Example 1

This example demonstrates that significant differences were found between the survival outcomes for R-CHOP treated ABC DLBCL and GCB DLBCL patients and that survival outcome correlated with three prognostic gene expression signatures.

Pre-treatment tumor biopsy specimens and clinical data were obtained from 414 patients with de novo DLBCL treated at 10 institutions in North America and Europe and studied according to a protocol approved by the National Cancer Institute's Institutional Review Board. Patients included in a "LLMP CHOP cohort" of 181 patients were treated with anthracycline-based combinations, most often cyclophosphamide, doxorubicin, vincristine, and prednisone (CHOP) or similar regimens, as previously described (Rosenwald et al., *N. Engl. J. Med.*, 346: 1937-47 (2002)). The remaining 233 patients constituted an R-CHOP cohort that received similar chemotherapy plus Rituximab. The median follow-up in the R-CHOP cohort was 2.1 years (2.8 years for survivors). A panel of expert hematopathologists confirmed the diagnosis of DLBCL using current WHO criteria. Additional clinical patient characteristics for the R-CHOP cohort are described in Table 2. Additional analysis used a second "MMMNLP CHOP" cohort of 177 patients studied by the Molecular Mechanisms of Non-Hodgkin's Lymphoma Network Project (Hummel et al., *N. Engl. J. Med.*, 354: 2419-30 (2006)).

TABLE 2

Clinical characteristics of DLBCL patients treated with R-CHOP

| Characteristic | % Total (N = 233) | % Germinal center B cell-like DLBCL (N = 107) | % Activated B cell-like DLBCL (N = 93) | % Unclassified DLBCL (N = 33) | P-value |
|---|---|---|---|---|---|
| Age > 60 yr | 52 | 47 | 63 | 39 | 0.02 |
| Ann Arbor stage > II | 54 | 48 | 62 | 50 | 0.06 |
| Lactate Dehydrogenase > 1x Normal | 48 | 43 | 58 | 41 | 0.06 |
| No. of extranodal sites > 1 | 15 | 14 | 15 | 14 | 0.8 |

TABLE 2-continued

Clinical characteristics of DLBCL patients treated with R-CHOP

| Characteristic | % Total (N = 233) | % Germinal center B cell-like DLBCL (N = 107) | % Activated B cell-like DLBCL (N = 93) | % Unclassified DLBCL (N = 33) | P-value |
|---|---|---|---|---|---|
| Eastern Cooperative Oncology Group (ECOG) performance status | 25 | 17 | 33 | 27 | 0.02 |
| International Prognostic Index (IPI) Score | | | | | <0.001 |
| 0 or 1 | 41 | 55 | 21 | 50 | |
| 2 or 3 | 46 | 33 | 63 | 38 | |
| 4 or 5 | 13 | 12 | 15 | 12 | |
| Revised IPI Score | | | | | <0.001 |
| 0 | 19 | 27 | 5 | 28 | |
| 1 or 2 | 56 | 52 | 64 | 48 | |
| 3-5 | 25 | 21 | 31 | 24 | |

Gene expression profiling was performed using Affymetrix U133+ 2.0 microarrays. Gene expression profiling data are available through the National Center for Biotechnology Information web site as described in Lenz et al., *New Engl. J. Med*, 359: 2313-23 (2008), at page 2314. All gene expression array data were normalized using MAS 5.0 software, and were log 2 transformed. To account for technical differences in the microarray processing between the R-CHOP cohort data and the LLMPP CHOP cohort data, the expression values of each gene in the R-CHOP cohort data were adjusted so that its median matched the median of the LLMPP CHOP data.

Gene expression signature identification and survival predictor model development were based solely on the data from the LLMPP CHOP training set. No prior survival analysis or subgroup analysis was performed with the test sets (MMMLNP CHOP and R-CHOP cohorts). The Cox model was used to identify genes associated with survival in the CHOP training set and to build multivariate survival models. The models and their associated scaling coefficients were fixed based on the CHOP training set and then evaluated on the test sets. The P-values of survival effects of continuous variables such as gene expression or signature expression were calculated with the Cox likelihood ratio test. The significance of survival effects based on discrete variables such as lymphoma subtype or International Prognostic Index (IPI) was calculated using the log rank test. Validation P-values presented are one-sided in the direction observed in the training set. All other P-values were two sided. Survival curves were estimated using the Kaplan-Meier method.

All aspects of gene expression signature identification and survival predictor model development were based solely on the data from the CHOP training set. No prior survival analysis or subgroup analysis was performed with the test sets (MMMLNP CHOP and R-CHOP cohorts). The Cox model was used to identify genes associated with survival in the CHOP training set and to build multivariate survival models. The models and their associated scale factors were fixed based on the CHOP training set, and then evaluated on the test sets.

Figure 1B:
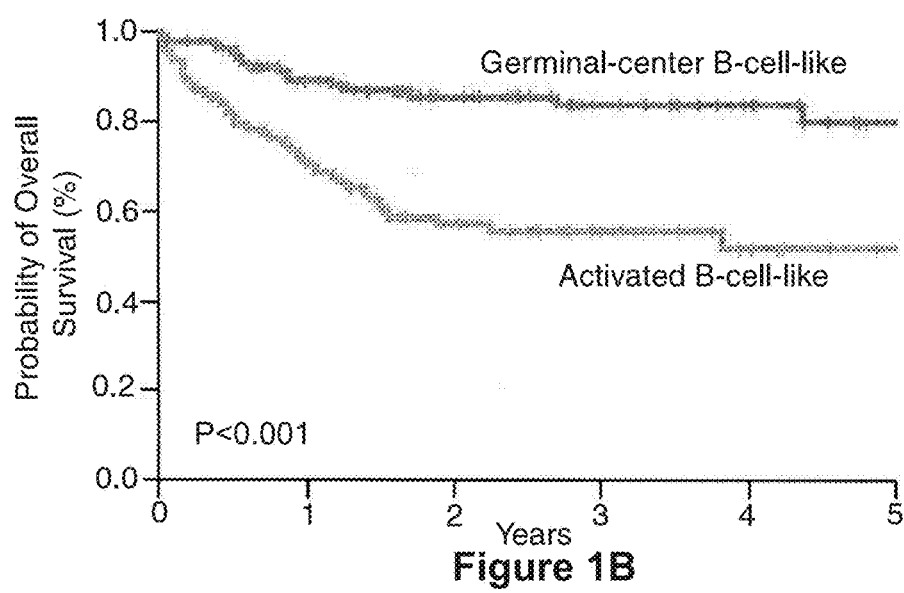
FIG. 1B a Kaplan-Meier estimates plot depicting the probability of overall survival versus time (in years) of patients with GCB DLBCL and ABC DLBCL. The plot indicates that GCB patients have a more favorable, i.e., higher probability, of overall survival than ABC patients for at least five years following R-CHOP therapy.
Figure 6A:
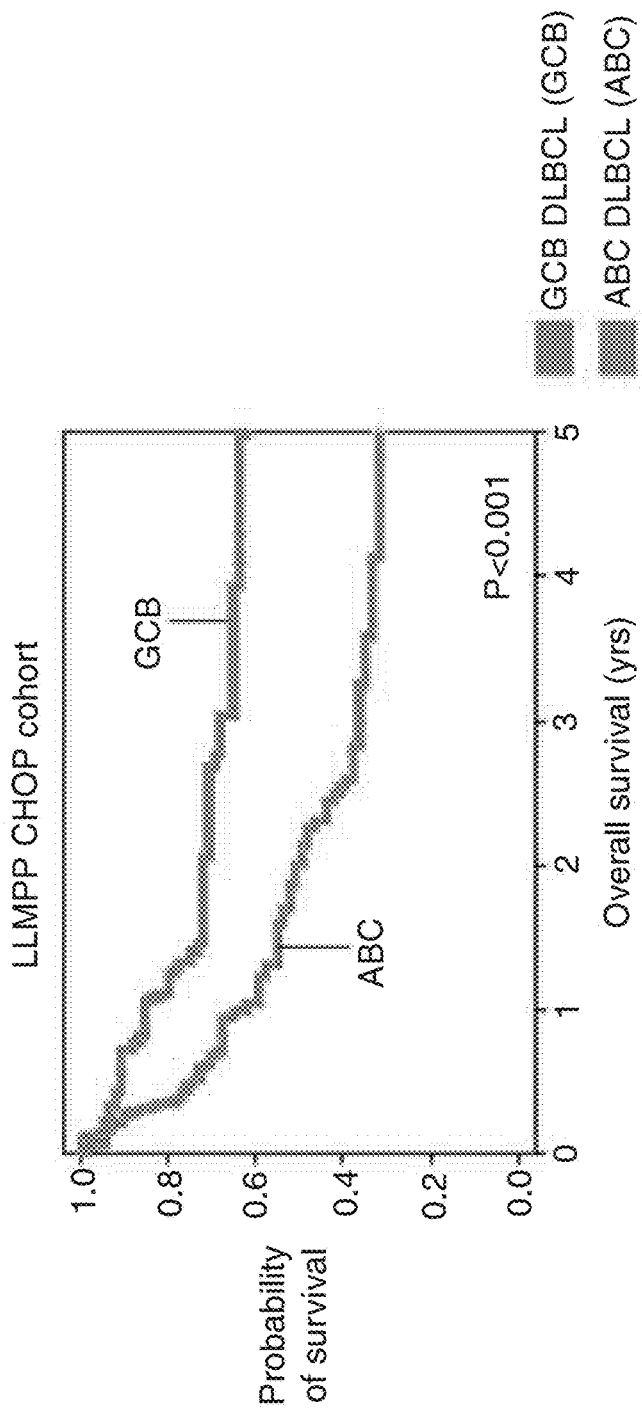
FIG. 6A is a Kaplan-Meier estimates plot depicting the probability of overall survival versus time (in years) for "LLMPP CHOP" patients with DLBCL following therapy. The plot indicates that in this cohort, patients with GCB DLBCL show significantly superior overall survival compared to patients with ABC DLBCL following CHOP therapy.
Figure 6B:
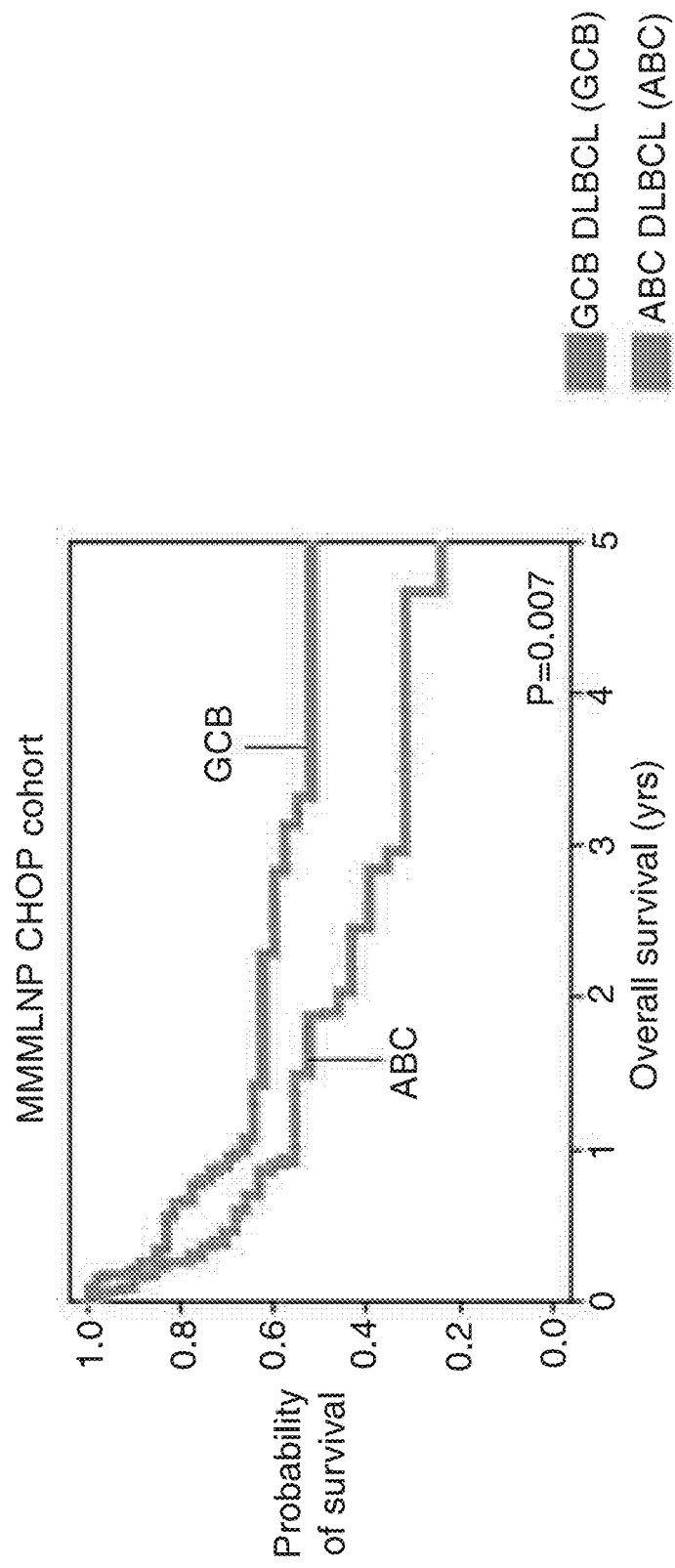
FIG. 6B is a is a Kaplan-Meier estimates plot depicting depicting the probability of overall survival versus time (in years) for "MMMLNP CHOP" patients with DLBCL following therapy. In this cohort, patients with GCB DLBCL show significantly superior overall survival compared to patients with ABC DLBCL following CHOP therapy.

Since ABC and GCB DLBCL subtypes have distinct overall survival rates with CHOP chemotherapy (Rosenwald et al., *N. Engl. J. Med.*, 346: 1937-47 (2002); Alizadeh et al., *Nature*, 403:503-11(2000); Hummel et al., *N. Engl. J. Med.*, 354:2419-30 (2006); Monti, *Blood*, 105:1851-61(2005)), whether this distinction remains prognostically significant among patients treated with R-CHOP was tested (Coiffier et al, *N. Engl. J. Med.*, 346: 235-42 (2002)). Gene expression profiles were determined for pre-treatment biopsy samples from a "training set" of 181 patients treated with CHOP or CHOP-like chemotherapy alone and from a "test set" of 233 patients treated with R-CHOP. The patients in these two cohorts were comparable with respect to age range and distribution of the clinical prognostic variables that constitute the International Prognostic Index (IPI) (Table 2). In the R-CHOP cohort, patients with GCB DLBCL had better survival rates than those with ABC DLBCL. Specifically, R-CHOP treated GCB DLBCL and ABC DLBCL patients had 3-year overall survival rates of 84% and 56%, respectively, and 3-year progression-free survival rates of 74% and 40%, respectively (FIGS. 1A and 1B). In the CHOP training set, and in a second "MMMLMP" CHOP cohort (Hummel et al., supra), the overall survival rates for ABC DLBCL and GCB DLBCL were lower than in the R-CHOP cohort (FIG. 6). Multivariate analysis indicated that the relative benefit (i.e., change in survival outcome) due to R-CHOP therapy (as compared to CHOP) was not significantly different between ABC and GCB DLBCL.

Figure 7:
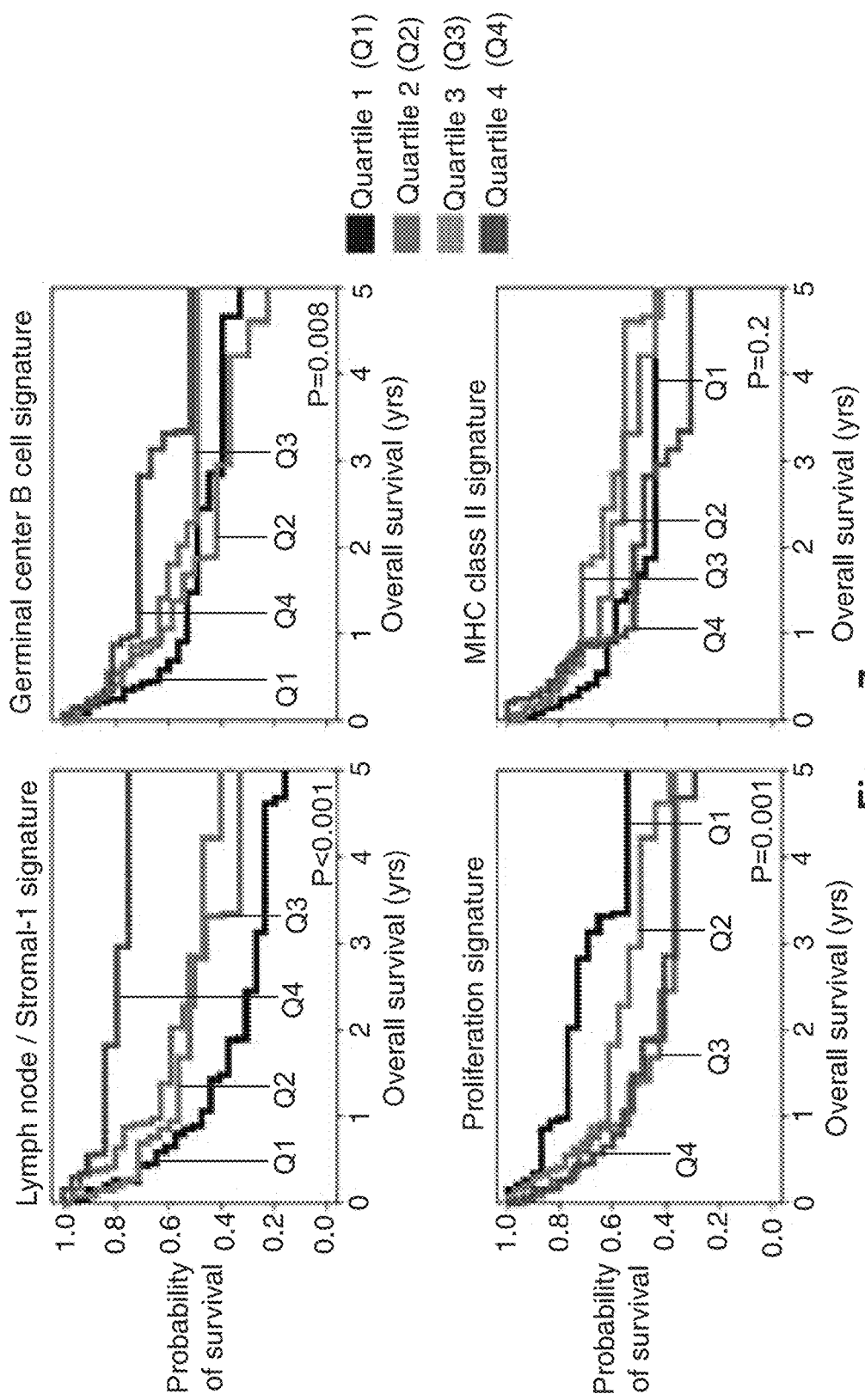
FIG. 7 is a set of four Kaplan-Meier estimates plots depicting the probability of overall survival versus time (in years) in a "MMMLNP CHOP" cohort. Each of the four plots correlates the probability of overall survival with the lymph node/stromal-1, germinal center B cell, proliferation, or MHC class II gene expression signature, respectively. Moreover, in each plot, the average expression of the signature genes in each biopsy sample was used to rank cases and divide the cohort into quartile groups as indicated.

Four gene expression signatures have been previously shown to have prognostic significance in DLBCL patients treated with CHOP (Rosenwald et al., supra). Of these, the GCB signature and lymph node signature were associated with favorable survival, and the proliferation signature was associated with inferior survival within the CHOP training set, in the MMMLNP CHOP cohort (see the corresponding signature panels in FIG. 7), and in the R-CHOP cohort (see corresponding signature panels in FIG. 1C). Thus, the biological differences among DLBCL tumors reflected by these three signatures remain prognostically important in Rituximab treated patients, even though Rituximab treatment generally improved survival in DLBCL.

Figure 1C:
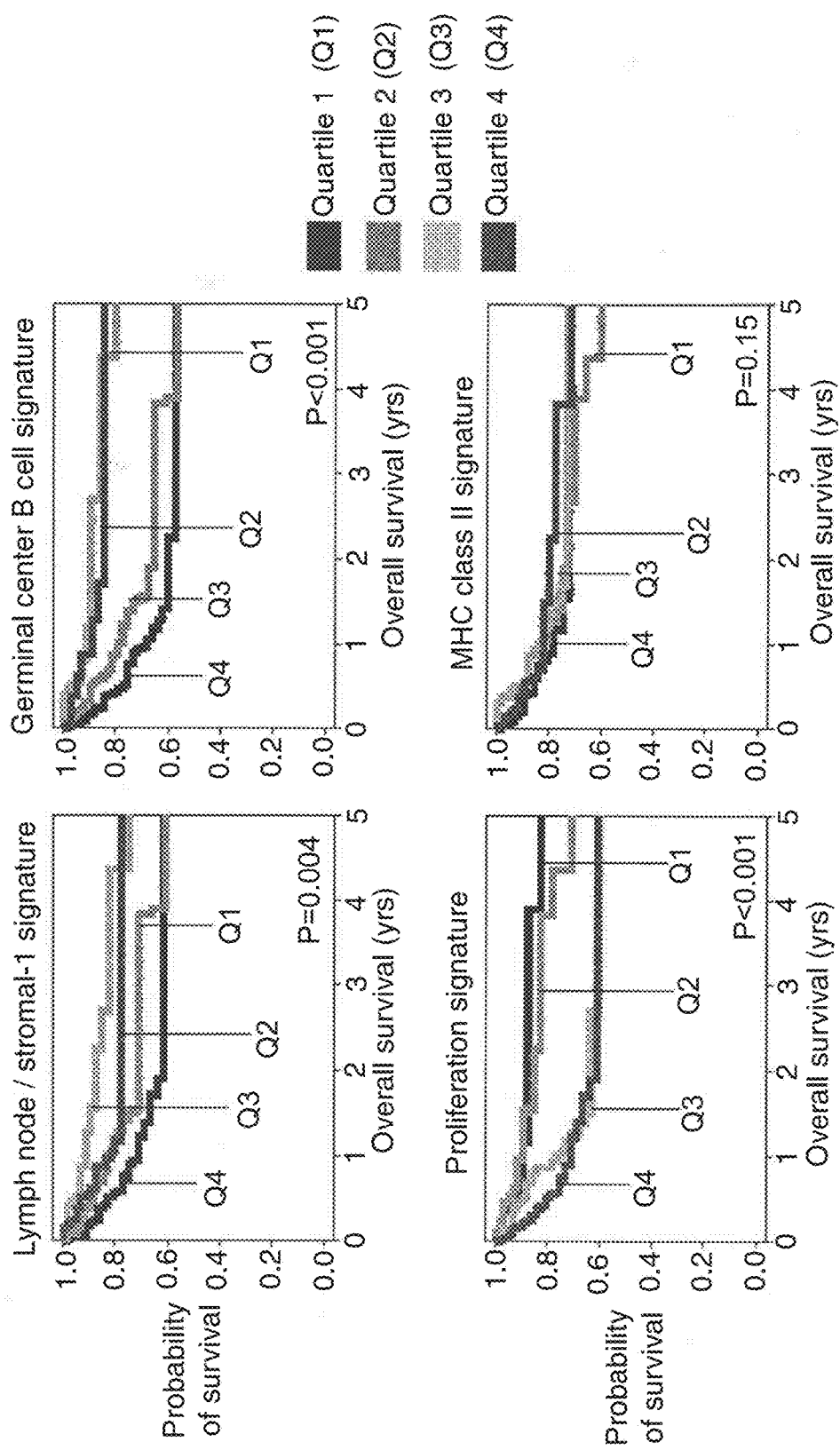
FIG. 1C is a series of four Kaplan-Meier estimates plots depicting the probabilities of overall survival versus time (in years) in DLBCL patients. Each of the four plots correlates the probability of overall survival with the lymph node/stromal-1, germinal center B cell, proliferation, or MHC class II gene expression signature, respectively. Moreover, in each plot, the average expression of the signature genes in each biopsy sample was used to rank cases and divide the cohort into quartile groups as indicated.
Figure 8A:
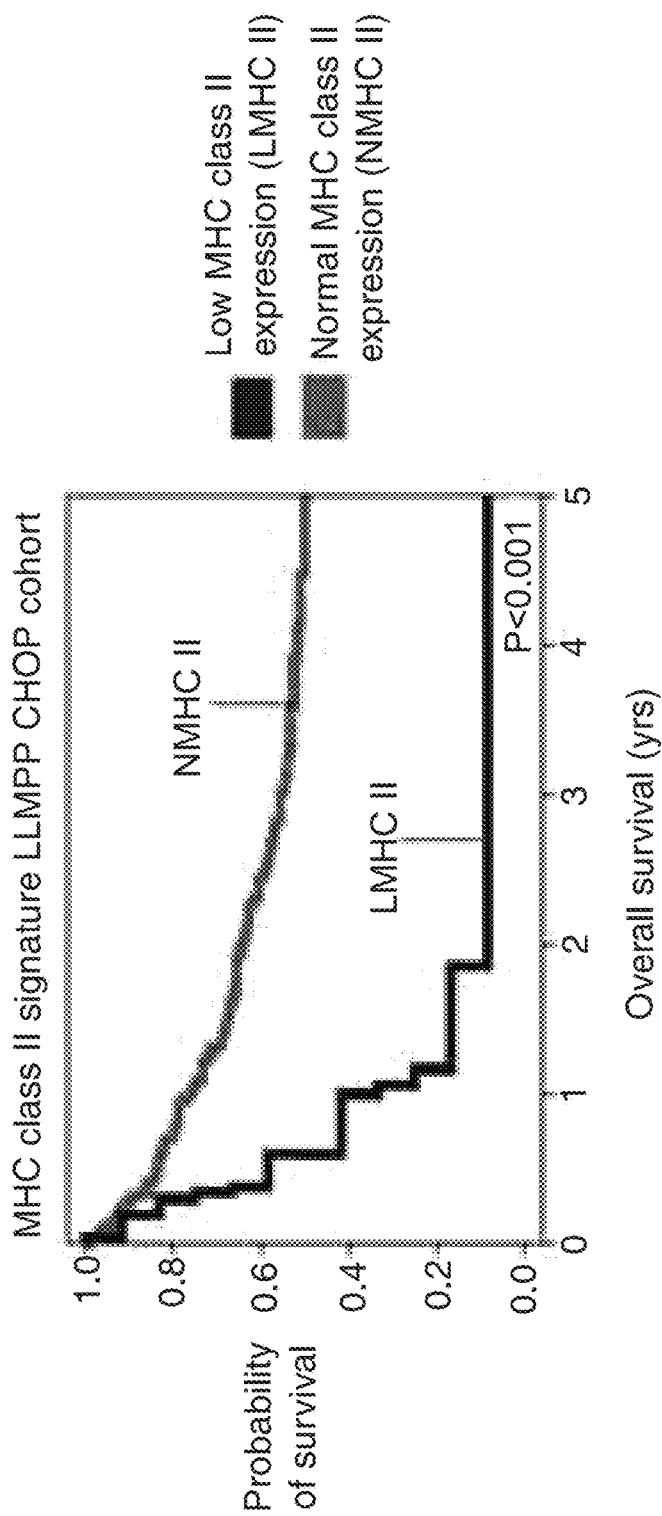
FIG. 8A is a Kaplan-Meier estimates plot depicting the probability of overall survival versus time (in years) in a "LLMPP CHOP" cohort, which was divided according to MHC class II signature expression levels. Patients with low MHC class II signature expression have significantly inferior overall survival compared to patients with normal MHC class II expression.
Figure 8B:
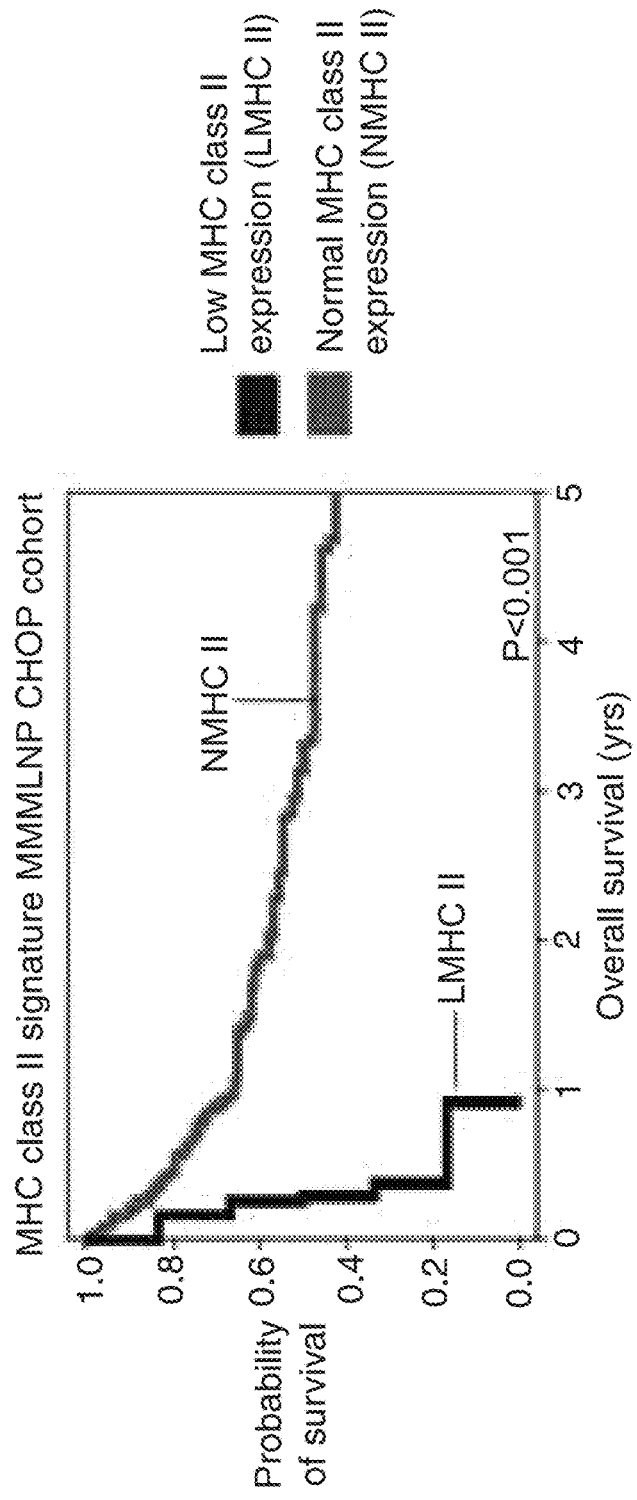
FIG. 8B is a Kaplan-Meier estimates plot depicting the probability of overall survival versus time (in years) in a "MMMLNP CHOP" cohort, which was divided according to MHC class II signature expression levels. Patients with low MHC class II signature expression have significantly inferior overall survival compared to patients with normal MHC class II expression.
Figure 8C:
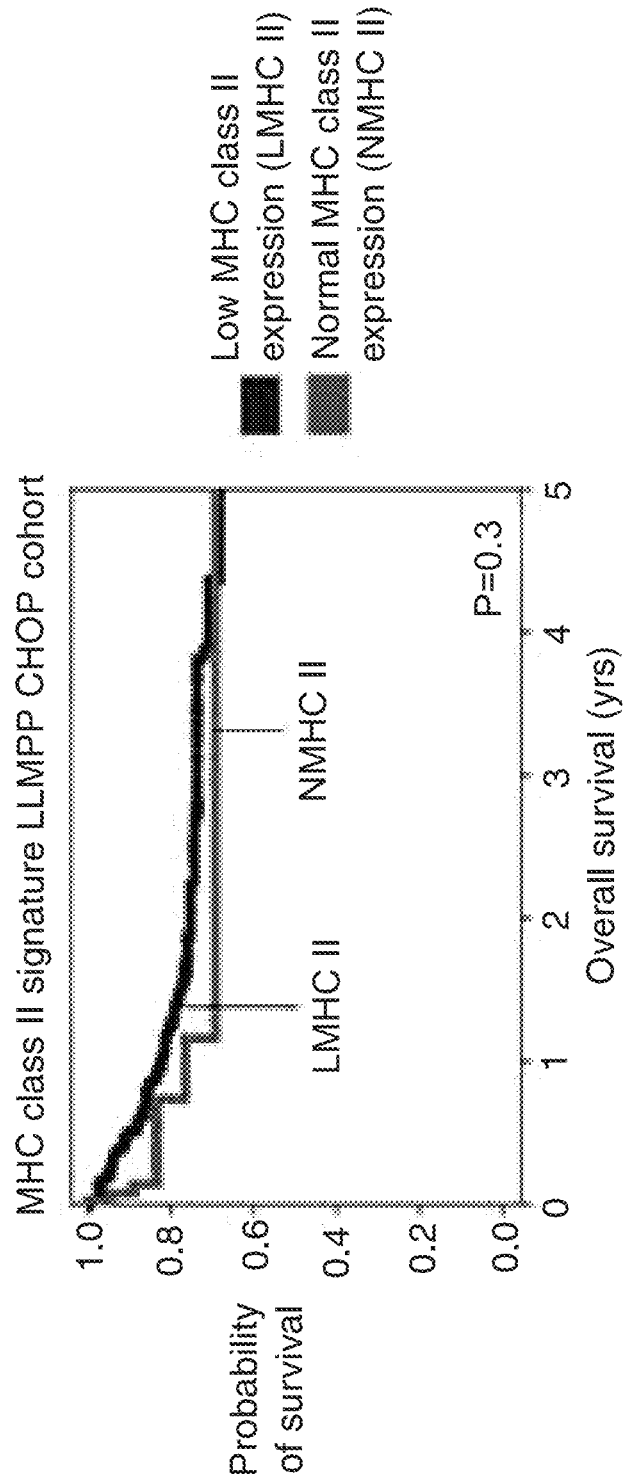
FIG. 8C is a Kaplan-Meier estimates plot depicting the probability of overall survival versus time (in years) in a "LLMPP R-CHOP" cohort, which was divided according to MHC class II signature expression levels. There was no significant difference in the overall survival of patients with low MHC class II signature expression as compared to patients with normal MHC class II expression.

The remaining fourth gene expression signature, the MHC class II signature, which was associated with survival in the CHOP training set when treated as a continuous variable, was not associated with survival in the R-CHOP cohort (see MHC class II signature panel in FIG. 1C). Moreover, tumors with extremely low "outlier" expression of this signature were associated with inferior survival in both CHOP cohorts (see FIGS. 8A and 8B), but not in the R-CHOP cohort (see FIG. 8C).

The foregoing results indicate that Rituximab immunotherapy combined with chemotherapy (R-CHOP) benefits both the ABC and GCB subtypes of DLBCL and that gene expression signatures that predicted survival in the context of CHOP chemotherapy retained their prognostic power among R-CHOP-treated patients.

The foregoing results also indicate that the biological variation among DLBCL tumors, as measured by gene expression signatures, has a consistent relationship to therapeutic response regardless of the treatment regimen used. There is a striking difference in 3-year progression-free survival between ABC DLBCL patients and GCB DLBCL patients treated with R-CHOP (40% vs. 74%). This difference is likely due to genetic and biological differences between these DLBCL subtypes (Staudt et al., *Adv. Immunol.*, 87: 163-208 (2005)).

Hence, future clinical trials in DLBCL should incorporate quantitative methods to discern these biological differences so that patient cohorts in different trials can be compared and treatment responses can be related to defined tumor phenotypes.

Example 2

This example demonstrates the development of GCB, stromal-1, and stromal-2 survival signatures and a related multivariate model of survival for R-CHOP-treated DLBCL.

Unless otherwise indicated, patient cohorts and methods of gene expression analysis are as described in Example 1.

In the LLMPP CHOP cohort data, 936 genes were identified as associated with poor prognosis $p<0.01$ (1-sided). For genes having multiple array probe sets associated with survival, only the probe set with the strongest association with survival was used. The expression values of the probe sets in the LLMPP CHOP cohort data were then clustered. The largest cluster with an average correlation of >0.6 and containing myc was identified as the proliferation survival signature. 1396 genes were identified as associated with favorable outcome. The largest cluster with average correlation of >0.6 and containing BCL6 was identified as the germinal center B cell (GCB) survival signature. A cluster with average correlation of >0.6 and containing FN1 was identified as the stromal-1 survival signature, whereas another cluster with average correlation of >0.6 containing HLADRA was identified as the MHC class II survival signature. The expression levels of genes within each signature were then averaged to create a "signature average" for each biopsy specimen. For the MMMLNP CHOP data set, the average was calculated for those array elements represented on the Affymetrix U133A microarray.

Figure 2A:
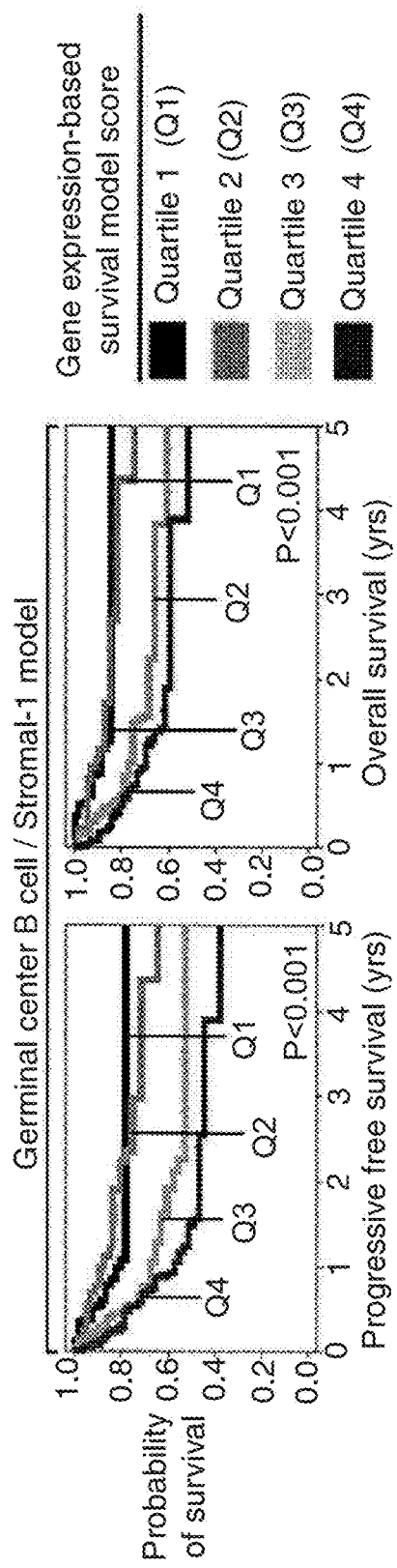
FIG. 2A is a pair of Kaplan-Meier estimates plots depicting the probability of progression-free-survival and the probability of overall survival, as indicated, versus time (in years) among DLBCL patients treated with R-CHOP. Patient samples were ranked according to a bivariate model created using the germinal center B cell (GCB) and stromal-1 signatures and divided into quartile groups.
Figure 9A:
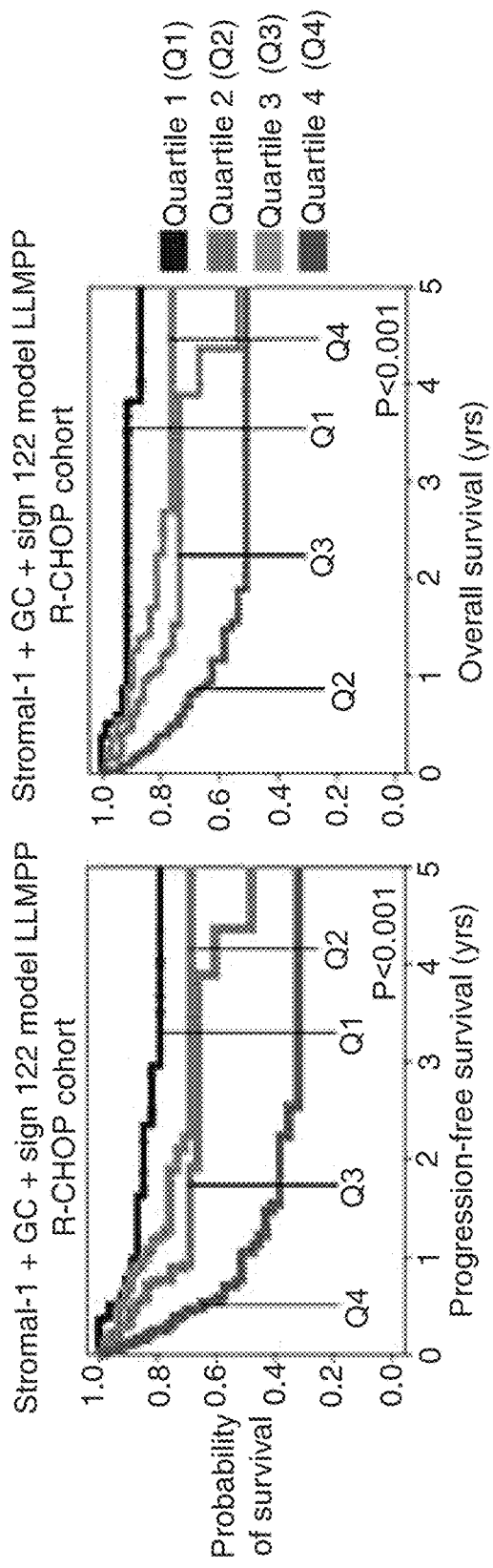
FIG. 9A is a pair of Kaplan-Meier estimates plots depicting the probabilities of progression-free survival or overall survival, as indicated, versus time (in years) among patients grouped into quartiles according to a gene expression model consisting of stromal-1 signature, GCB signature, and signature 122 following R-CHOP therapy.

From the four prognostic clusters or signatures, two signatures, the stromal-1 and the GCB signatures were used to create the best two variable survival model. Neither the proliferation nor the MHC class II signatures added to the prognostic value of this two variable model. This bivariate model performed well in the MMMLNP CHOP cohort (FIG. 9A) and in the R-CHOP cohort (FIG. 2A).

The CHOP training set was used to discover and refine signatures that added to the prognostic significance of this bivariate model, and the resulting multivariate models were tested in the R-CHOP cohort. 563 genes were identified as adding to the model in the direction of adverse prognosis. These genes were clustered by hierarchical clustering, and three clusters of more than 10 genes with an average correlation of >0.6 were identified. In addition, 542 genes were identified which added to the stromal-1 and GCB signature model in the direction of favorable prognosis. These genes were clustered, and two clusters of more than 10 genes with an average correlation of >0.6 were identified. Signature averages were determined for these clusters, and three variable models containing the stromal-1 and GCB signature and each of the cluster averages were formed on the MMMLNP CHOP and R-CHOP data sets. Of the five cluster averages, two were found to add statistical significance ($p<0.02$) in the MMMLNP CHOP data as compared to a model containing the stromal-1 and GCB signatures alone. By contrast, in the R-CHOP data, three of the five cluster averages were found to add significance ($p<0.02$) to the bivariate model. One of these cluster averages added significantly to the bivariate model in both the MMMLNP CHOP and R-CHOP data. This signature, designated Signature 122, was also found to add to the stromal-1 and GCB signature far more significantly than any of the four other signatures on the LLMPP CHOP data and, thus, was retained for further analysis.

Figure 2B:
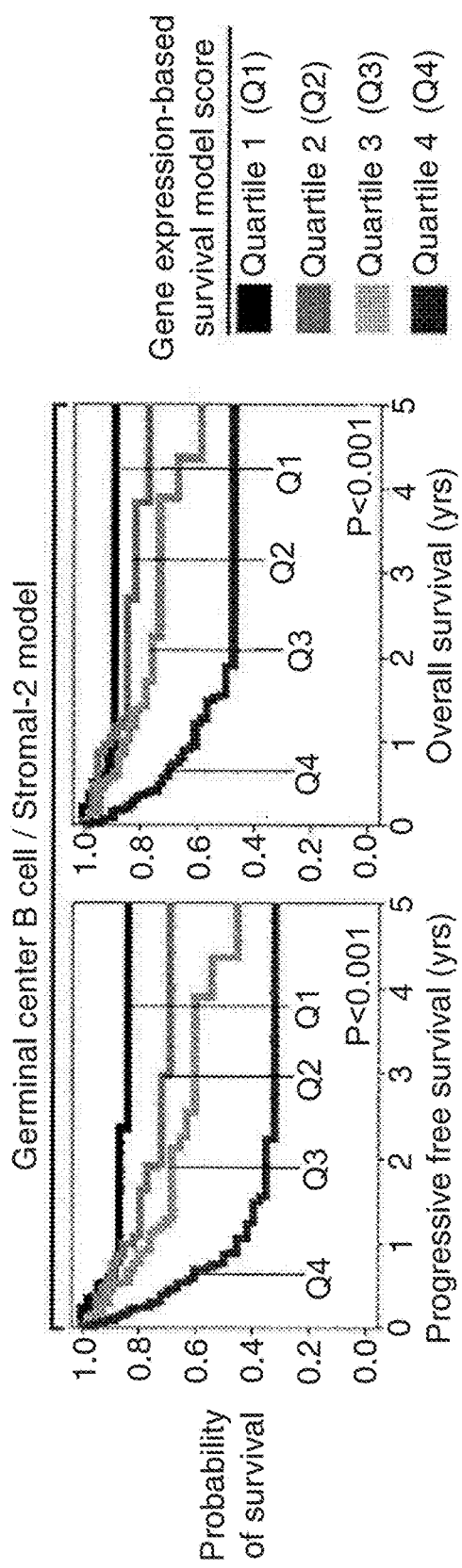
FIG. 2B is a pair of Kaplan-Meier plots depicting the probability of progression-free-survival and the probability of overall survival, as indicated, versus time (in years) among DLBCL patients treated with R-CHOP. Patient samples were ranked according to a survival predictor score derived from a model incorporating the germinal center B cell, stromal-1, and stromal-2 signatures and divided into quartile groups.
Figure 9B:
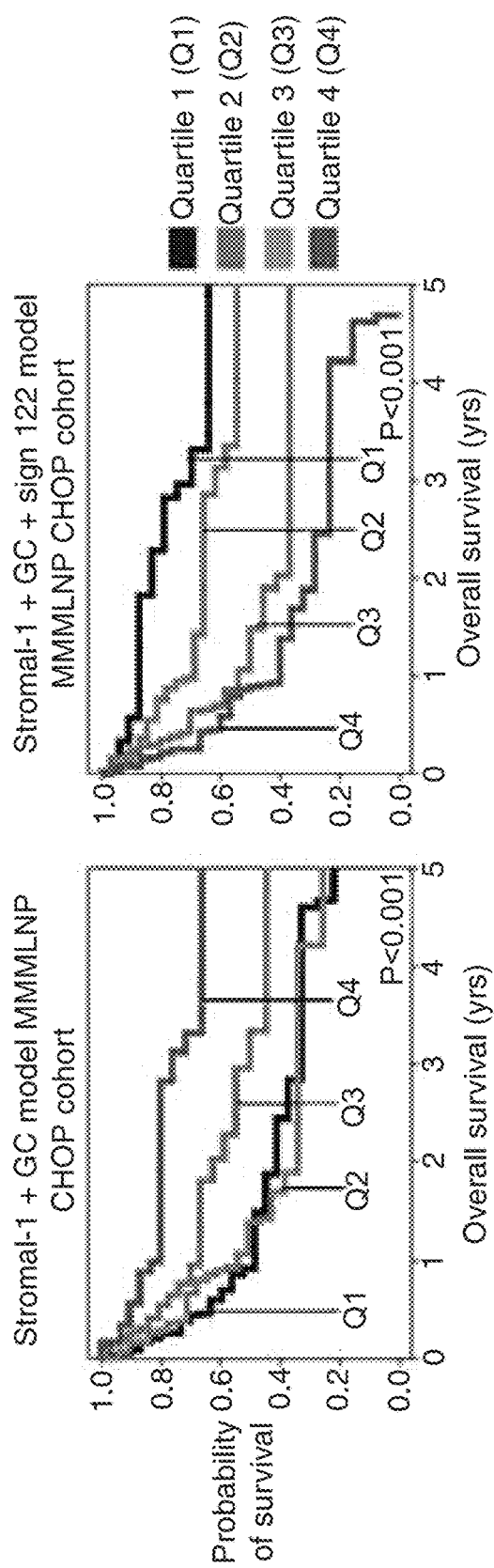
FIG. 9B is a pair Kaplan-Meier estimates plots depicting the probabilities of overall survival versus time (in years) among "MMMLNP CHOP" cohort patients grouped into quartiles according to a gene expression model consisting of either stromal-1 signature and GCB signature or stromal-1, GCB signature, and signature 122, as indicated, following CHOP therapy.
Figure 9C:
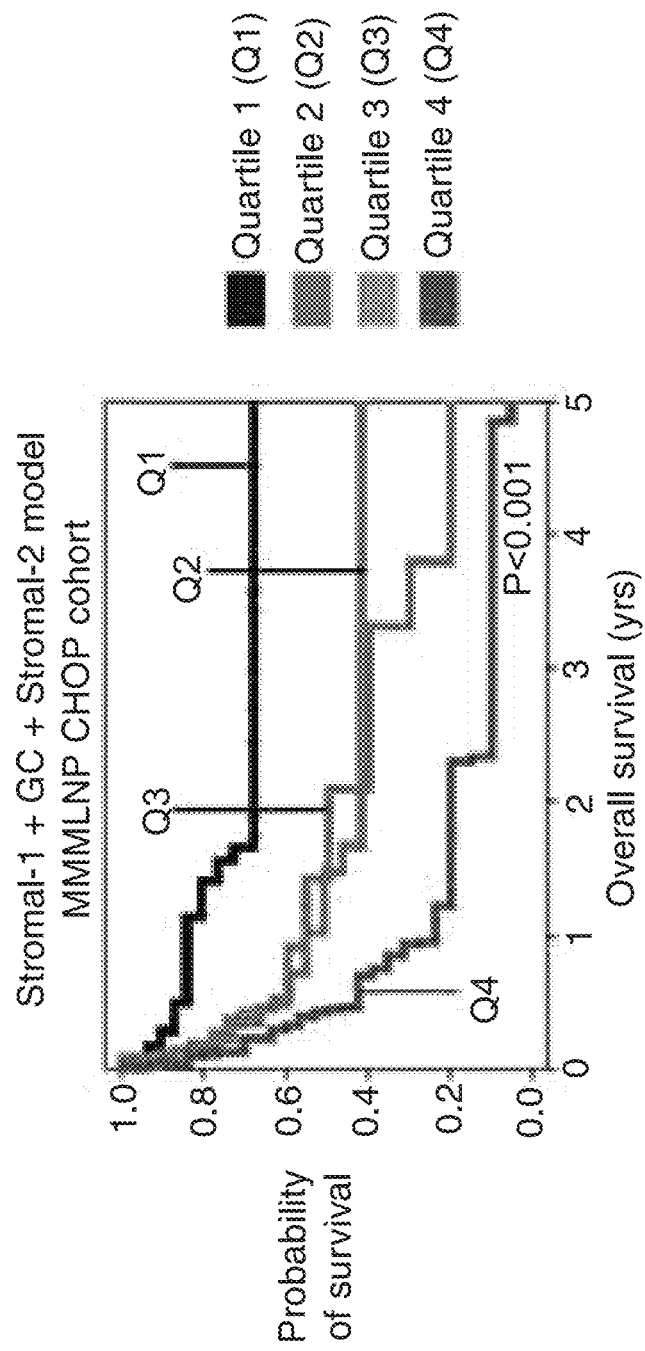
FIG. 9C is a Kaplan-Meier estimates plot depicting the probabilities of overall survival versus time (in years) among "MMMLNP CHOP" cohort patients grouped into quartiles according to a gene expression model consisting of stromal-1 signature, GCB signature, and stromal-2 signature following CHOP therapy.

Signature 122 added significantly to the bivariate model in both the MMMLNP CHOP cohort ($p=0.011$) and in the R-CHOP cohort ($p=0.001$) (FIGS. 9B and 9C). This Signature 122 positively correlated with the stromal-1 signature, although it was associated with adverse survival when added to the bivariate model. To further refine our model, we identified genes that were more correlated with Signature 122 than with the stromal-1 signature ($p<0.02$). These genes were organized by hierarchical clustering, and three sets of correlated genes ($r>0.6$) were observed. One of these clusters, the stromal-2 signature, added to the significance of the bivariate model in both the MMMLNP CHOP cohort ($p=0.002$) and the R-CHOP cohort ($p<0.001$) (FIGS. 2B and 9D).

Figure 3:
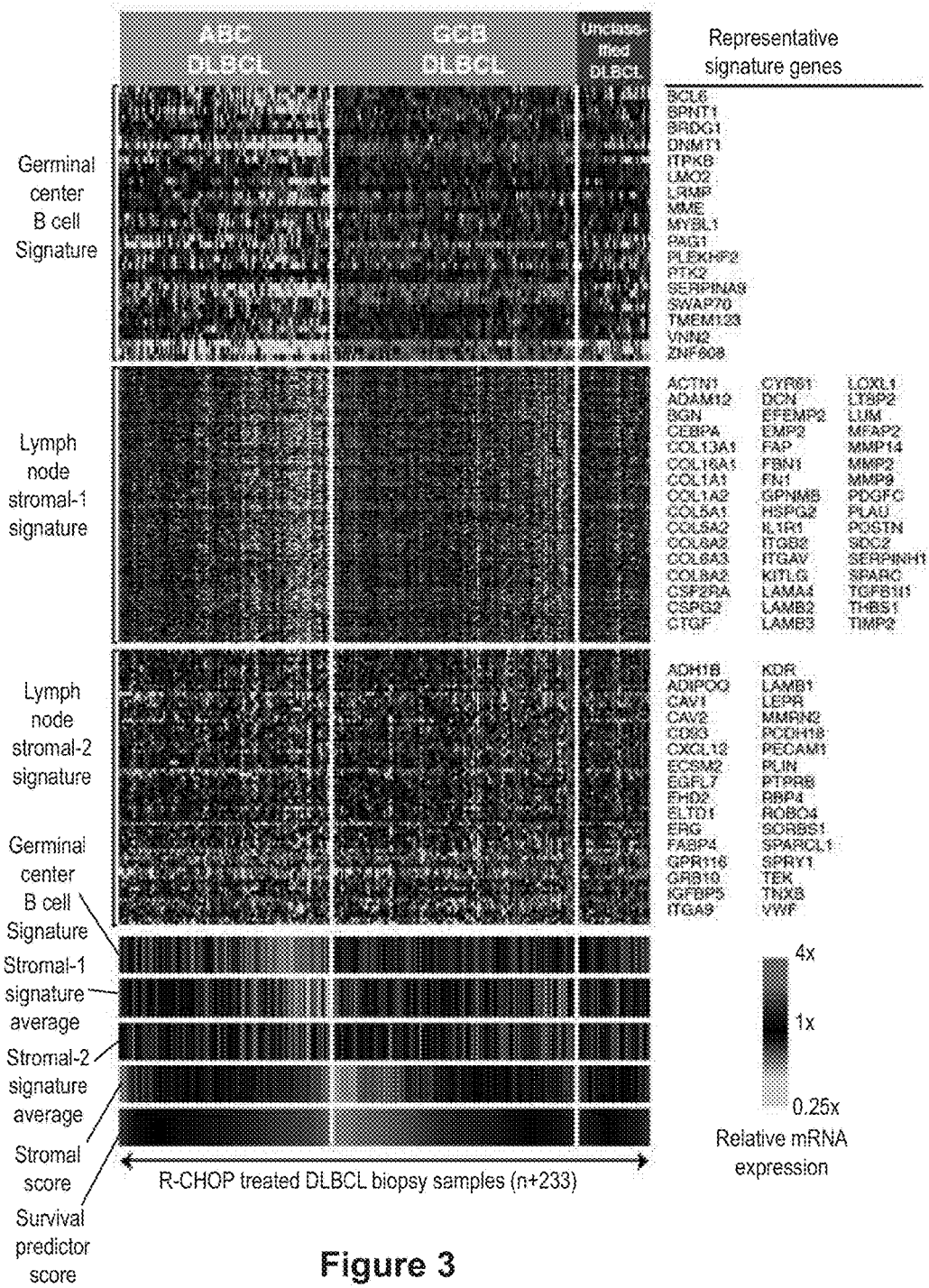
FIG. 3 depicts the expression levels of the indicated GCB cell, stromal-1, and stromal-2 signature genes in ABC, GCB, and unclassified DLBCL biopsy samples. Relative levels of gene expression are depicted according to the scale shown. Shown at the bottom are the signature averages for each patient. Also shown is the stromal score, which is the component of the survival model contributed by the difference between the stromal-2 and stromal-1 signature averages. The survival predictor score is shown for each patient and was used to order the cases, after grouping into ABC DLBCL, GCB DLBCL, and unclassified categories.

A multivariate survival model was formed by fitting a Cox model with the GCB, stromal-1, and stromal-2 signatures to the LLMPP CHOP cohort data shown in Table 3. This final multivariate model with its associated scaling coefficients was then evaluated on the MMLLMPP CHOP and R-CHOP cohort data sets. Survival predictor scores from the final model were used to divide the R-CHOP cohort into quartile groups with 3-year overall survival rates of 89%, 82%, 74%, and 48%, and 3-year progression-free survival rates of 84%, 69%, 61% and 33% (FIG. 2B). The survival predictor scores from the final model are illustrated in FIG. 3 along with the three component signatures and representative genes of each signature.

TABLE 3

| Patient | Time to death or last follow up (years) | Status at last follow up (1 = dead, 0 = alive) | Time to death, progression, or last follow up (years) | Status at last follow up (1 = progressed or died, 0 = no progression) | Germinal Center Signature Average | Stromal-1 Signature Average | Stromal-2 Signature Average | Model Score |
|---|---|---|---|---|---|---|---|---|
| 2 | 2.75 | 0 | 2.75 | 0 | 9.238 | 8.778 | 7.475 | 0.376 |
| 3 | 2.67 | 0 | 2.67 | 0 | 9.942 | 8.227 | 7.102 | 0.387 |
| 5 | 1.27 | 1 | 0.72 | 1 | 8.859 | 9.033 | 8.716 | 1.113 |

TABLE 3-continued

| Patient | Time to death or last follow up (years) | Status at last follow up (1 = dead, 0 = alive) | Time to death, progression, or last follow up (years) | Status at last follow up (1 = progressed or died, 0 = no progression) | Germinal Center Signature Average | Stromal-1 Signature Average | Stromal-2 Signature Average | Model Score |
|---|---|---|---|---|---|---|---|---|
| 21 | 2.39 | 0 | 2.40 | 0 | 10.573 | 8.519 | 6.959 | −0.270 |
| 22 | 2.38 | 0 | 2.38 | 0 | 8.737 | 8.686 | 7.598 | 0.761 |
| 23 | 2.52 | 0 | 2.52 | 0 | 10.694 | 10.322 | 8.817 | −0.897 |
| 24 | 5.11 | 0 | 5.11 | 0 | 11.376 | 7.854 | 7.598 | 0.500 |
| 26 | 4.01 | 0 | 4.01 | 0 | 9.829 | 9.956 | 8.507 | −0.372 |
| 28 | 3.96 | 0 | 3.96 | 0 | 10.957 | 9.277 | 8.248 | −0.330 |
| 41 | 0.52 | 1 | 0.52 | 1 | 9.273 | 9.437 | 8.202 | 0.183 |
| 47 | 1.53 | 1 | 0.77 | 1 | 9.548 | 8.802 | 8.061 | 0.617 |
| 48 | 0.37 | 1 | 0.12 | 1 | 8.660 | 8.279 | 6.891 | 0.729 |
| 49 | 2.37 | 0 | 2.35 | 1 | 10.915 | 8.988 | 6.847 | −0.965 |
| 53 | 3.89 | 0 | 2.23 | 1 | 9.530 | 9.792 | 9.693 | 0.721 |
| 61 | 0.90 | 1 | 0.46 | 1 | 8.649 | 8.038 | 8.104 | 1.798 |
| 65 | 4.04 | 0 | 4.04 | 0 | 10.744 | 9.330 | 7.930 | −0.508 |
| 66 | 4.04 | 0 | 4.04 | 0 | 10.714 | 10.016 | 7.536 | −1.459 |
| 95 | 0.62 | 1 | 0.44 | 1 | 9.244 | 9.197 | 8.105 | 0.373 |
| 96 | 5.37 | 0 | 5.37 | 0 | 10.107 | 8.723 | 7.608 | 0.157 |
| 97 | 5.07 | 0 | 5.07 | 0 | 9.777 | 9.192 | 7.359 | −0.349 |
| 98 | 0.94 | 1 | 0.59 | 1 | 8.794 | 7.711 | 7.367 | 1.571 |
| 99 | 0.40 | 1 | 0.40 | 1 | 9.024 | 9.272 | 9.160 | 1.101 |
| 103 | 0.03 | 1 | 0.02 | 1 | 8.883 | 8.190 | 7.742 | 1.301 |
| 104 | 3.76 | 0 | 3.76 | 0 | 9.785 | 9.866 | 7.929 | −0.652 |
| 106 | 2.95 | 0 | 2.95 | 0 | 10.585 | 7.797 | 6.824 | 0.367 |
| 107 | 2.94 | 0 | 2.94 | 0 | 11.535 | 8.358 | 6.660 | −0.711 |
| 108 | 2.73 | 0 | 2.73 | 0 | 9.653 | 8.495 | 7.550 | 0.539 |
| 109 | 0.16 | 1 | 0.11 | 1 | 9.301 | 9.376 | 7.994 | 0.092 |
| 110 | 2.46 | 0 | 2.46 | 0 | 10.254 | 8.980 | 7.324 | −0.357 |
| 111 | 2.44 | 0 | 2.44 | 0 | 10.137 | 10.691 | 8.948 | −0.949 |
| 113 | 2.12 | 0 | 2.12 | 0 | 10.746 | 8.555 | 6.942 | −0.390 |
| 114 | 1.98 | 0 | 0.88 | 1 | 8.562 | 8.159 | 7.120 | 1.047 |
| 115 | 1.92 | 0 | 1.92 | 0 | 10.313 | 9.385 | 8.157 | −0.231 |
| 118 | 1.64 | 0 | 1.64 | 0 | 10.209 | 10.194 | 8.231 | −0.959 |
| 119 | 1.60 | 0 | 1.60 | 0 | 11.059 | 8.852 | 7.479 | −0.461 |
| 1087 | 0.05 | 1 | 0.05 | 1 | 8.756 | 8.491 | 7.949 | 1.188 |
| 1089 | 5.12 | 0 | 1.27 | 1 | 9.863 | 9.135 | 8.034 | 0.129 |
| 1091 | 5.15 | 0 | 5.15 | 0 | 10.454 | 9.918 | 8.742 | −0.437 |
| 1092 | 5.06 | 0 | 5.07 | 0 | 9.452 | 9.467 | 8.912 | 0.556 |
| 1093 | 3.83 | 1 | 1.62 | 1 | 9.915 | 9.138 | 7.747 | −0.090 |
| 1096 | 4.02 | 0 | 4.02 | 0 | 8.887 | 9.236 | 7.795 | 0.274 |
| 1097 | 1.26 | 1 | 1.08 | 1 | 11.219 | 9.234 | 8.321 | −0.347 |
| 1098 | 3.53 | 0 | 3.53 | 0 | 9.117 | 9.236 | 7.655 | 0.082 |
| 1099 | 3.07 | 0 | 0.91 | 1 | 9.284 | 8.798 | 7.741 | 0.515 |
| 1101 | 5.64 | 0 | 5.64 | 0 | 9.803 | 9.466 | 8.156 | −0.101 |
| 1108 | 3.30 | 0 | 3.30 | 0 | 9.195 | 10.456 | 9.065 | −0.237 |
| 1109 | 3.78 | 0 | 3.78 | 0 | 11.008 | 10.051 | 8.273 | −1.120 |
| 1164 | 0.19 | 1 | 0.16 | 1 | 9.242 | 10.307 | 10.548 | 0.896 |
| 1167 | 1.49 | 1 | 0.45 | 1 | 9.809 | 9.105 | 8.784 | 0.687 |
| 1168 | 0.42 | 1 | 0.30 | 1 | 8.718 | 8.368 | 7.149 | 0.790 |
| 1169 | 1.71 | 1 | 1.22 | 1 | 11.512 | 8.108 | 7.507 | 0.125 |
| 1172 | 2.82 | 0 | 2.82 | 0 | 11.137 | 8.871 | 8.153 | −0.057 |
| 1173 | 0.87 | 1 | 0.79 | 1 | 11.324 | 9.914 | 8.514 | −0.950 |
| 1175 | 1.06 | 1 | 0.56 | 1 | 9.107 | 10.310 | 9.063 | −0.053 |
| 1179 | 2.53 | 0 | 2.53 | 0 | 9.506 | 9.437 | 8.461 | 0.260 |
| 1181 | 1.72 | 0 | 1.72 | 0 | 10.688 | 9.018 | 7.647 | −0.360 |
| 1184 | 4.74 | 0 | 2.97 | 1 | 10.812 | 8.979 | 7.922 | −0.187 |
| 1185 | 3.71 | 0 | 3.71 | 0 | 10.431 | 8.397 | 7.317 | 0.156 |
| 1186 | 3.43 | 0 | 3.43 | 0 | 8.688 | 8.944 | 8.552 | 1.164 |
| 1187 | 5.23 | 0 | 5.23 | 0 | 10.072 | 10.192 | 8.667 | −0.604 |
| 1189 | 5.13 | 0 | 5.13 | 0 | 10.109 | 9.212 | 7.967 | −0.097 |
| 1190 | 3.66 | 0 | 3.66 | 0 | 10.713 | 10.409 | 8.910 | −0.930 |
| 1192 | 0.16 | 1 | 0.16 | 1 | 8.825 | 9.903 | 8.061 | −0.199 |
| 1195 | 4.36 | 0 | 4.36 | 0 | 11.539 | 7.567 | 6.873 | 0.234 |
| 1197 | 3.13 | 0 | 3.13 | 0 | 10.287 | 10.365 | 9.549 | −0.275 |
| 1200 | 0.31 | 1 | 0.31 | 1 | 9.432 | 8.950 | 9.805 | 1.692 |
| 1206 | 6.51 | 0 | 6.51 | 0 | 10.410 | 9.946 | 8.925 | −0.323 |
| 1211 | 6.25 | 0 | 6.25 | 0 | 11.596 | 7.908 | 6.524 | −0.372 |
| 1215 | 5.35 | 0 | 5.35 | 0 | 10.504 | 9.061 | 7.550 | −0.392 |
| 1216 | 0.46 | 1 | 0.29 | 1 | 10.017 | 9.010 | 7.794 | 0.028 |
| 1219 | 0.51 | 1 | 0.51 | 1 | 10.614 | 10.014 | 8.619 | −0.683 |
| 1220 | 2.24 | 1 | 2.25 | 1 | 8.850 | 9.400 | 8.036 | 0.286 |
| 1221 | 3.94 | 0 | 3.95 | 0 | 8.777 | 7.489 | 6.672 | 1.334 |
| 1222 | 3.53 | 0 | 3.53 | 0 | 10.463 | 9.310 | 7.019 | −0.986 |
| 1224 | 3.22 | 0 | 2.11 | 1 | 9.751 | 9.505 | 8.453 | 0.082 |
| 1225 | 2.95 | 0 | 2.95 | 0 | 8.613 | 8.313 | 7.668 | 1.240 |
| 1226 | 0.08 | 1 | 0.08 | 1 | 9.229 | 8.851 | 7.950 | 0.625 |
| 1228 | 2.78 | 0 | 0.99 | 1 | 11.532 | 8.261 | 6.932 | −0.428 |

TABLE 3-continued

| Patient | Time to death or last follow up (years) | Status at last follow up (1 = dead, 0 = alive) | Time to death, progression, or last follow up (years) | Status at last follow up (1 = progressed or died, 0 = no progression) | Germinal Center Signature Average | Stromal-1 Signature Average | Stromal-2 Signature Average | Model Score |
|---|---|---|---|---|---|---|---|---|
| 1230 | 0.59 | 1 | 0.54 | 1 | 9.369 | 6.951 | 6.956 | 1.825 |
| 1231 | 1.41 | 0 | 1.41 | 0 | 10.248 | 8.788 | 8.011 | 0.303 |
| 1232 | 2.49 | 0 | 0.68 | 1 | 10.362 | 8.528 | 7.975 | 0.495 |
| 1233 | 2.50 | 0 | 2.50 | 0 | 9.239 | 10.581 | 8.470 | −0.784 |
| 1236 | 2.56 | 0 | 2.56 | 0 | 9.156 | 10.000 | 7.805 | −0.608 |
| 1238 | 0.16 | 1 | 0.16 | 1 | 9.488 | 9.055 | 8.256 | 0.517 |
| 1239 | 2.24 | 0 | 2.24 | 0 | 8.886 | 8.978 | 7.838 | 0.564 |
| 1240 | 1.48 | 0 | 1.48 | 0 | 10.474 | 9.073 | 7.702 | −0.288 |
| 1241 | 1.41 | 1 | 1.17 | 1 | 9.044 | 9.054 | 7.451 | 0.160 |
| 1251 | 2.72 | 0 | 2.72 | 0 | 8.410 | 8.687 | 7.082 | 0.549 |
| 1252 | 0.01 | 1 | 0.01 | 1 | 11.167 | 8.070 | 7.358 | 0.206 |
| 1255 | 5.17 | 0 | 5.17 | 0 | 9.501 | 9.411 | 7.887 | −0.099 |
| 1271 | 4.72 | 0 | 4.73 | 0 | 10.718 | 8.452 | 7.060 | −0.194 |
| 1272 | 5.68 | 0 | 5.68 | 0 | 9.161 | 9.080 | 7.668 | 0.231 |
| 1275 | 1.89 | 1 | 1.48 | 1 | 9.257 | 8.559 | 8.607 | 1.354 |
| 1277 | 5.06 | 0 | 5.07 | 0 | 11.091 | 9.938 | 8.274 | −1.038 |
| 1279 | 4.87 | 0 | 4.87 | 0 | 9.309 | 10.085 | 9.676 | 0.504 |
| 1281 | 3.36 | 0 | not available (n/a) | n/a | 9.535 | 9.969 | 9.090 | 0.132 |
| 1284 | 3.51 | 0 | 3.51 | 0 | 10.922 | 9.680 | 8.481 | −0.567 |
| 1288 | 1.54 | 0 | n/a | n/a | 9.430 | 8.896 | 8.037 | 0.554 |
| 1289 | 0.03 | 1 | 0.03 | 1 | 8.915 | 9.052 | 8.002 | 0.589 |
| 1290 | 5.23 | 0 | 5.23 | 0 | 10.432 | 10.426 | 8.154 | −1.340 |
| 1291 | 0.04 | 1 | 0.04 | 1 | 11.319 | 8.246 | 7.323 | −0.059 |
| 1292 | 0.10 | 1 | 0.10 | 1 | 8.667 | 8.764 | 8.110 | 1.058 |
| 1293 | 4.81 | 0 | 4.81 | 0 | 11.116 | 9.842 | 8.083 | −1.081 |
| 1294 | 0.53 | 1 | 0.53 | 1 | 10.138 | 10.181 | 8.501 | −0.733 |
| 1295 | 5.16 | 0 | 5.17 | 0 | 9.445 | 9.694 | 7.739 | −0.463 |
| 1296 | 4.79 | 0 | 4.79 | 0 | 10.228 | 9.064 | 8.852 | 0.600 |
| 1297 | 4.24 | 0 | 4.24 | 0 | 9.524 | 7.990 | 7.008 | 0.740 |
| 1298 | 4.56 | 0 | 4.56 | 0 | 9.022 | 9.000 | 7.695 | 0.389 |
| 1331 | 3.29 | 0 | 3.29 | 0 | 11.004 | 9.488 | 8.289 | −0.536 |
| 1334 | 2.87 | 0 | 2.87 | 0 | 11.434 | 9.509 | 8.109 | −0.859 |
| 1335 | 1.38 | 1 | 0.90 | 1 | 9.586 | 8.545 | 7.423 | 0.431 |
| 1336 | 2.44 | 0 | 2.44 | 0 | 10.844 | 9.704 | 7.706 | −1.082 |
| 1337 | 0.02 | 1 | 0.02 | 1 | 8.521 | 7.788 | 7.860 | 1.941 |
| 1449 | 1.62 | 0 | 1.62 | 0 | 9.604 | 8.463 | 8.030 | 0.917 |
| 1450 | 1.30 | 0 | 0.53 | 1 | 8.571 | 8.112 | 7.241 | 1.173 |
| 1451 | 1.84 | 0 | 1.85 | 0 | 10.637 | 9.205 | 7.759 | −0.452 |
| 1453 | 1.71 | 0 | 1.71 | 0 | 10.964 | 9.089 | 8.226 | −0.157 |
| 1454 | 0.62 | 0 | 0.62 | 0 | 11.106 | 8.514 | 7.604 | −0.052 |
| 1553 | 2.93 | 0 | 1.92 | 1 | 8.975 | 9.284 | 7.475 | −0.029 |
| 1612 | 5.37 | 0 | 5.37 | 0 | 10.526 | 9.471 | 7.809 | −0.643 |
| 1613 | 5.81 | 0 | n/a | n/a | 10.868 | 9.695 | 7.730 | −1.067 |
| 1614 | 4.36 | 1 | 4.36 | 1 | 10.358 | 9.226 | 8.765 | 0.322 |
| 1617 | 0.52 | 0 | 0.52 | 0 | 10.332 | 8.723 | 7.180 | −0.227 |
| 1618 | 1.70 | 0 | 0.98 | 1 | 11.233 | 8.956 | 7.852 | −0.387 |
| 1619 | 0.25 | 1 | 0.25 | 1 | 8.646 | 8.028 | 7.123 | 1.146 |
| 1620 | 2.17 | 0 | 2.17 | 0 | 11.647 | 8.385 | 7.343 | −0.325 |
| 1623 | 2.80 | 0 | 2.80 | 0 | 9.611 | 9.484 | 8.249 | 0.024 |
| 1626 | 1.76 | 0 | 1.76 | 0 | 11.236 | 9.495 | 8.108 | −0.763 |
| 1628 | 3.13 | 0 | 1.23 | 1 | 8.714 | 7.972 | 7.149 | 1.192 |
| 1645 | 2.85 | 0 | 2.85 | 0 | 10.146 | 9.476 | 8.914 | 0.258 |
| 1647 | 2.79 | 0 | 2.80 | 0 | 10.485 | 10.495 | 8.707 | −1.058 |
| 1650 | 0.75 | 1 | 0.75 | 1 | 8.830 | 7.346 | 6.486 | 1.333 |
| 1651 | 1.66 | 0 | 1.66 | 0 | 9.190 | 7.949 | 6.829 | 0.801 |
| 1652 | 1.64 | 0 | n/a | n/a | 8.798 | 8.943 | 8.331 | 0.969 |
| 1702 | 1.05 | 0 | 1.05 | 1 | 9.008 | 8.217 | 8.078 | 1.447 |
| 1703 | 0.70 | 1 | 0.70 | 1 | 9.499 | 8.637 | 7.790 | 0.621 |
| 1704 | 3.14 | 0 | 3.14 | 0 | 9.908 | 9.231 | 7.503 | −0.347 |
| 1705 | 3.94 | 0 | 3.94 | 0 | 8.933 | 8.445 | 8.187 | 1.321 |
| 1707 | 2.80 | 0 | 2.80 | 0 | 10.610 | 9.348 | 7.872 | −0.510 |
| 1742 | 3.27 | 0 | n/a | n/a | 10.033 | 8.715 | 7.412 | 0.063 |
| 1746 | 1.91 | 0 | 1.55 | 1 | 9.249 | 8.705 | 8.205 | 0.937 |
| 1747 | 1.48 | 0 | 1.48 | 0 | 10.162 | 8.866 | 7.602 | −0.016 |
| 1756 | 3.47 | 0 | 3.47 | 0 | 10.815 | 9.638 | 7.248 | −1.312 |
| 1761 | 0.23 | 1 | 0.23 | 1 | 9.842 | 10.192 | 8.664 | −0.511 |
| 1762 | 5.20 | 0 | 5.20 | 0 | 10.583 | 9.333 | 7.445 | −0.772 |
| 1763 | 5.51 | 0 | 5.51 | 0 | 8.917 | 8.925 | 8.084 | 0.771 |
| 1766 | 1.59 | 0 | 1.59 | 0 | 10.919 | 10.037 | 8.389 | −0.990 |
| 1782 | 1.09 | 0 | 1.09 | 0 | 10.753 | 9.600 | 8.332 | −0.516 |
| 1788 | 0.39 | 1 | 0.24 | 1 | 10.364 | 8.738 | 8.914 | 0.915 |
| 1861 | 0.56 | 1 | 0.19 | 1 | 9.728 | 8.604 | 7.594 | 0.427 |
| 1867 | 1.17 | 1 | 0.38 | 1 | 8.903 | 11.501 | 10.559 | −0.166 |
| 1916 | 1.41 | 0 | n/a | n/a | 9.295 | 11.197 | 11.508 | 0.619 |
| 1920 | 1.32 | 0 | 1.32 | 0 | 10.165 | 9.630 | 8.789 | 0.009 |

TABLE 3-continued

| Patient | Time to death or last follow up (years) | Status at last follow up (1 = dead, 0 = alive) | Time to death, progression, or last follow up (years) | Status at last follow up (1 = progressed or died, 0 = no progression) | Germinal Center Signature Average | Stromal-1 Signature Average | Stromal-2 Signature Average | Model Score |
|---|---|---|---|---|---|---|---|---|
| 1927 | 1.53 | 0 | 1.53 | 0 | 9.195 | 10.261 | 9.791 | 0.451 |
| 1928 | 0.72 | 0 | 0.72 | 0 | 9.769 | 8.510 | 7.330 | 0.328 |
| 1939 | 0.47 | 1 | 0.47 | 1 | 9.097 | 9.363 | 7.647 | −0.043 |
| 2002 | 1.29 | 0 | 1.30 | 0 | 9.469 | 9.542 | 8.600 | 0.262 |
| 2006 | 1.23 | 0 | 1.23 | 0 | 10.434 | 8.223 | 7.162 | 0.227 |
| 2067 | 2.18 | 0 | 2.18 | 0 | 10.244 | 11.186 | 9.391 | −1.197 |
| 2070 | 0.31 | 0 | 0.12 | 1 | 10.486 | 10.680 | 10.353 | −0.135 |
| 2162 | 0.38 | 1 | 0.38 | 1 | 10.934 | 10.020 | 7.960 | −1.268 |
| 2270 | 1.59 | 0 | 1.59 | 0 | 10.117 | 9.904 | 8.506 | −0.440 |
| 2271 | 1.60 | 0 | 1.60 | 0 | 8.995 | 9.349 | 8.261 | 0.428 |
| 2274 | 0.41 | 0 | 0.41 | 0 | 8.863 | 7.623 | 7.222 | 1.533 |
| 2283 | 1.19 | 0 | 1.19 | 0 | 10.501 | 8.361 | 6.741 | −0.226 |
| 2291 | 0.87 | 1 | 0.85 | 1 | 10.732 | 10.184 | 9.436 | −0.353 |
| 2299 | 0.93 | 0 | 0.93 | 0 | 10.661 | 9.905 | 8.189 | −0.883 |
| 2301 | 0.61 | 0 | 0.61 | 0 | 9.852 | 9.903 | 8.352 | −0.432 |
| 2306 | 0.68 | 0 | 0.68 | 0 | 8.586 | 8.759 | 8.191 | 1.151 |
| 2309 | 0.43 | 0 | 0.43 | 0 | 10.839 | 7.671 | 6.860 | 0.413 |
| 2311 | 0.80 | 0 | 0.80 | 0 | 10.901 | 7.797 | 6.912 | 0.294 |
| 2318 | 0.99 | 0 | 0.99 | 0 | 10.283 | 9.403 | 8.655 | 0.100 |
| 2321 | 0.82 | 0 | 0.82 | 0 | 9.691 | 8.956 | 7.404 | −0.044 |
| 2411 | 0.67 | 0 | 0.67 | 0 | 8.986 | 8.383 | 7.854 | 1.137 |
| 2415 | 0.62 | 0 | 0.62 | 0 | 9.296 | 10.509 | 9.551 | −0.005 |
| 2444 | 3.99 | 0 | 3.99 | 0 | 10.154 | 9.871 | 9.026 | −0.071 |
| 2445 | 3.36 | 0 | 3.36 | 0 | 8.788 | 8.184 | 7.964 | 1.497 |
| 2479 | 0.51 | 0 | 0.51 | 0 | 11.151 | 9.023 | 8.199 | −0.186 |
| 2482 | 4.54 | 0 | 4.54 | 0 | 10.373 | 9.847 | 8.208 | −0.691 |
| 2483 | 3.89 | 1 | 3.89 | 1 | 9.241 | 8.902 | 7.742 | 0.428 |
| 2484 | 2.69 | 1 | 1.90 | 1 | 10.279 | 9.619 | 8.312 | −0.349 |
| 2485 | 4.43 | 0 | 4.43 | 0 | 9.957 | 9.865 | 8.439 | −0.378 |
| 2486 | 4.37 | 0 | n/a | n/a | 10.698 | 10.203 | 8.041 | −1.301 |
| 2487 | 4.34 | 0 | 4.34 | 0 | 11.227 | 9.909 | 8.260 | −1.076 |
| 2488 | 4.20 | 0 | 4.21 | 0 | 9.510 | 8.709 | 7.615 | 0.426 |
| 2490 | 4.02 | 0 | 4.02 | 0 | 10.510 | 10.961 | 8.956 | −1.374 |
| 2491 | 0.50 | 1 | 0.25 | 1 | 9.047 | 8.554 | 7.624 | 0.784 |
| 2492 | 3.96 | 0 | 3.96 | 0 | 9.904 | 10.901 | 9.140 | −0.935 |
| 2497 | 3.44 | 0 | 3.44 | 0 | 9.221 | 9.438 | 8.065 | 0.111 |
| 2498 | 3.37 | 0 | 3.37 | 0 | 9.318 | 9.427 | 8.003 | 0.040 |
| 2500 | 3.31 | 0 | 3.31 | 0 | 11.014 | 9.406 | 7.375 | −1.074 |
| 2501 | 3.28 | 0 | n/a | n/a | 8.822 | 8.551 | 7.750 | 0.966 |
| 2503 | 2.99 | 0 | 2.99 | 0 | 8.301 | 7.967 | 6.929 | 1.222 |
| 2504 | 2.78 | 0 | 2.78 | 0 | 10.145 | 8.004 | 7.017 | 0.472 |
| 2505 | 2.76 | 0 | 2.76 | 0 | 11.036 | 8.442 | 7.136 | −0.266 |
| 2507 | 0.86 | 1 | 0.54 | 1 | 9.737 | 9.475 | 8.988 | 0.480 |
| 2508 | 2.58 | 0 | 2.58 | 0 | 8.678 | 9.389 | 8.230 | 0.498 |
| 2509 | 0.96 | 1 | 0.76 | 1 | 8.895 | 10.441 | 9.088 | −0.081 |
| 2511 | 1.55 | 1 | 1.06 | 1 | 9.225 | 9.267 | 9.191 | 1.042 |
| 2512 | 2.45 | 0 | 2.45 | 0 | 11.047 | 10.465 | 9.337 | −0.838 |
| 2513 | 0.61 | 1 | 0.61 | 1 | 10.855 | 10.378 | 8.395 | −1.305 |
| 2514 | 2.18 | 0 | 2.18 | 0 | 10.477 | 9.832 | 7.498 | −1.198 |
| 2515 | 2.13 | 0 | 2.13 | 0 | 9.295 | 10.519 | 9.788 | 0.145 |
| 2516 | 2.07 | 0 | 2.07 | 0 | 10.575 | 10.592 | 8.642 | −1.238 |
| 2517 | 2.04 | 0 | 0.76 | 1 | 9.385 | 9.163 | 8.328 | 0.498 |
| 2584 | 0.68 | 0 | 0.68 | 0 | 10.759 | 9.356 | 8.135 | −0.404 |
| 2599 | 4.05 | 0 | 4.05 | 0 | 10.629 | 9.158 | 7.724 | −0.425 |
| 2600 | 1.01 | 1 | 0.54 | 1 | 9.785 | 8.619 | 7.291 | 0.184 |
| 2601 | 1.22 | 1 | 0.88 | 1 | 9.385 | 8.044 | 7.178 | 0.859 |
| 2603 | 4.43 | 0 | 4.43 | 0 | 9.582 | 10.707 | 9.803 | −0.156 |
| 2604 | 0.84 | 0 | 0.36 | 1 | 9.844 | 10.511 | 8.382 | −1.026 |
| 2609 | 8.89 | 0 | 2.55 | 1 | 8.981 | 8.775 | 7.506 | 0.507 |
| 2610 | 0.74 | 0 | 0.74 | 0 | 10.793 | 8.964 | 7.421 | −0.502 |
| 2611 | 0.66 | 0 | 0.66 | 0 | 10.353 | 10.233 | 9.032 | −0.518 |
| 2612 | 1.17 | 1 | 1.13 | 1 | 10.290 | 9.028 | 8.287 | 0.230 |
| 2613 | 1.66 | 0 | 1.66 | 0 | 10.997 | 9.089 | 7.749 | −0.493 |
| 2614 | 0.21 | 1 | 0.21 | 1 | 8.768 | 7.850 | 7.100 | 1.261 |
| 2615 | 0.48 | 0 | 0.48 | 0 | 11.359 | 9.470 | 7.647 | −1.100 |
| 2639 | 10.29 | 0 | 10.30 | 0 | 11.085 | 10.385 | 8.003 | −1.674 |
| 2641 | 1.38 | 0 | 1.38 | 0 | 9.199 | 8.818 | 7.340 | 0.259 |
| 2642 | 3.67 | 0 | 3.67 | 0 | 10.731 | 8.777 | 7.167 | −0.458 |
| 2643 | 5.49 | 0 | 5.49 | 0 | 10.236 | 10.578 | 8.473 | −1.197 |
| 2645 | 0.19 | 0 | n/a | n/a | 11.130 | 9.997 | 8.254 | −1.129 |
| 2646 | 0.18 | 1 | 0.18 | 1 | 8.893 | 7.648 | 6.871 | 1.260 |
| 2648 | 0.25 | 0 | 0.25 | 0 | 8.855 | 7.745 | 7.060 | 1.303 |
| 2649 | 2.13 | 0 | 2.13 | 0 | 9.688 | 10.354 | 9.885 | 0.214 |
| 2650 | 2.43 | 0 | n/a | n/a | 10.007 | 10.052 | 8.861 | −0.305 |
| 2651 | 1.61 | 0 | n/a | n/a | 10.660 | 9.452 | 7.831 | −0.665 |

TABLE 3-continued

| Patient | Time to death or last follow up (years) | Status at last follow up (1 = dead, 0 = alive) | Time to death, progression, or last follow up (years) | Status at last follow up (1 = progressed or died, 0 = no progression) | Germinal Center Signature Average | Stromal-1 Signature Average | Stromal-2 Signature Average | Model Score |
|---|---|---|---|---|---|---|---|---|
| 2652 | 1.84 | 0 | 1.84 | 0 | 11.378 | 9.247 | 7.684 | −0.856 |
| 2653 | 1.88 | 0 | 1.88 | 0 | 11.182 | 9.638 | 7.781 | −1.106 |
| 2654 | 1.43 | 0 | 1.43 | 0 | 8.791 | 9.395 | 8.905 | 0.902 |
| 2813 | 3.97 | 0 | 3.97 | 0 | 10.701 | 9.366 | 8.258 | −0.306 |
| 2814 | 0.81 | 1 | 0.70 | 1 | 10.561 | 9.176 | 9.275 | 0.632 |

Figure 2C:
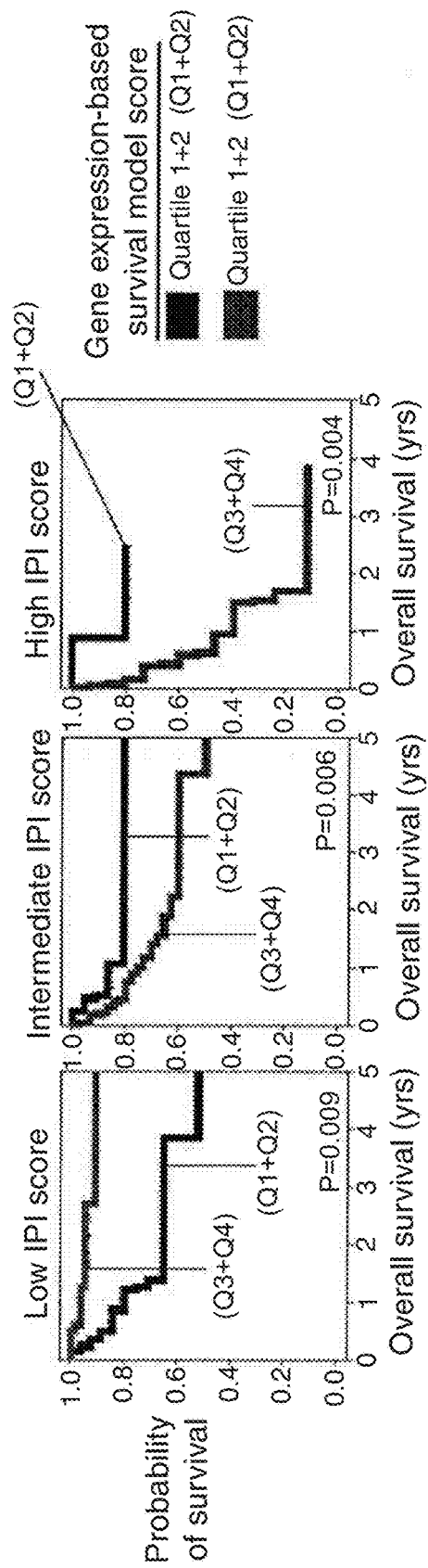
FIG. 2C is a series of three Kaplan-Meier estimates plots depicting the probability of overall survival versus time (in years) among R-CHOP treated DLBCL patients in the indicated low, intermediate, or high IPI risk groups. Patient samples were stratified according to the same survival predictor score used in FIG. 2B, except that the first and second quartiles were merged, and the third and fourth quartiles were merged.
Figure 10A:
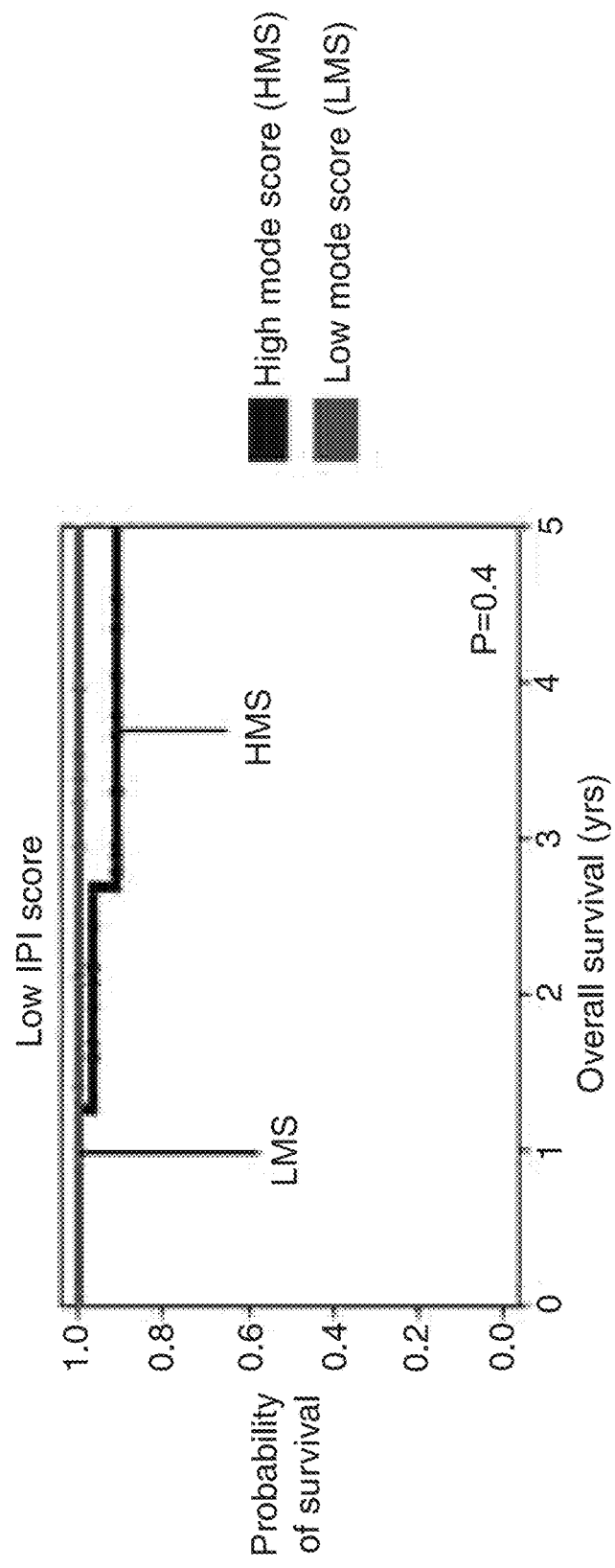
FIG. 10A is a Kaplan-Meier estimates plot depicting the overall survival among low revised International Prognostic Index (IPI) risk group patients stratified according to the gene expression-based outcome predictor score. After grouping patients into quartiles according to gene expression-based outcome predictor score, quartiles 1 and 2 were merged (Low Model Score), and quartiles 3 and 4 were merged (High Model Score).
Figure 10B:
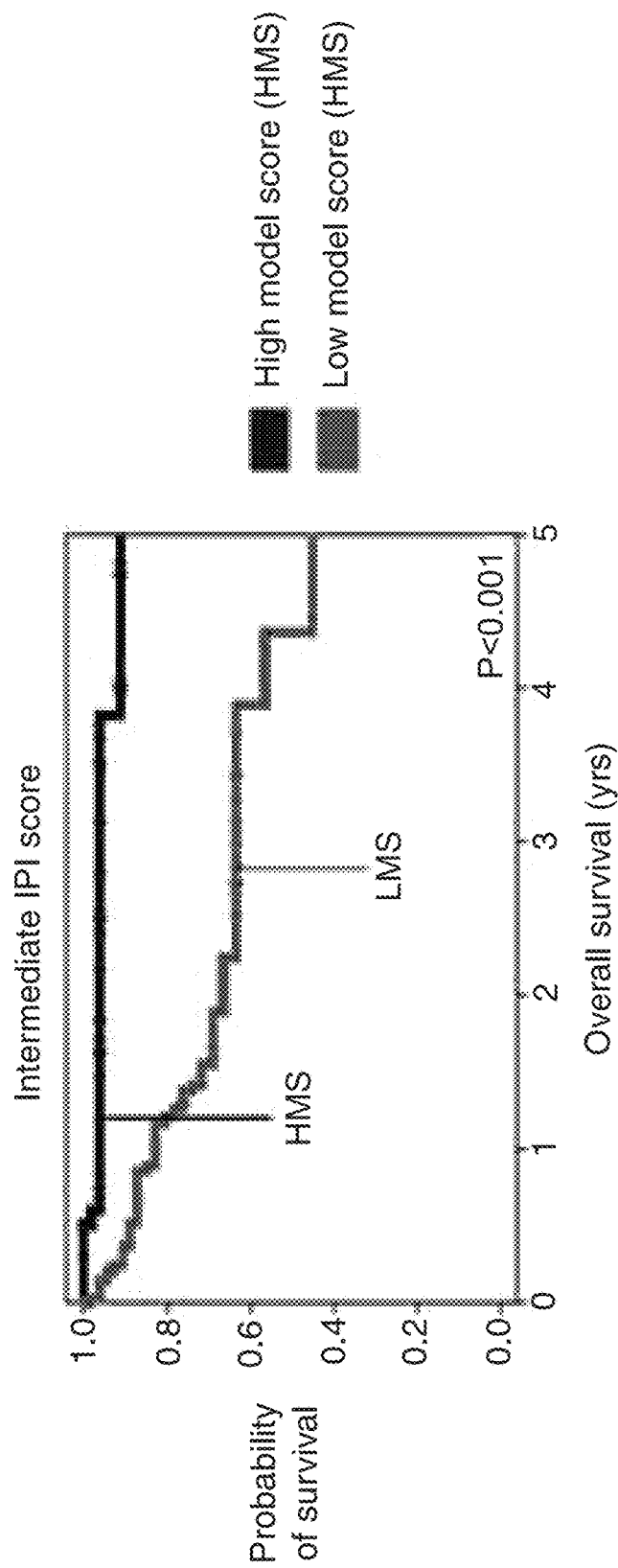
FIG. 10B is a Kaplan-Meier estimates plot depicting the overall survival among intermediate revised International Prognostic Index (IPI) risk group patients stratified according to the gene expression-based outcome predictor. After grouping patients into quartiles according to gene expression-based outcome predictor score, quartiles 1 and 2 were merged (Low Model Score), and quartiles 3 and 4 were merged (High Model Score).
Figure 10C:
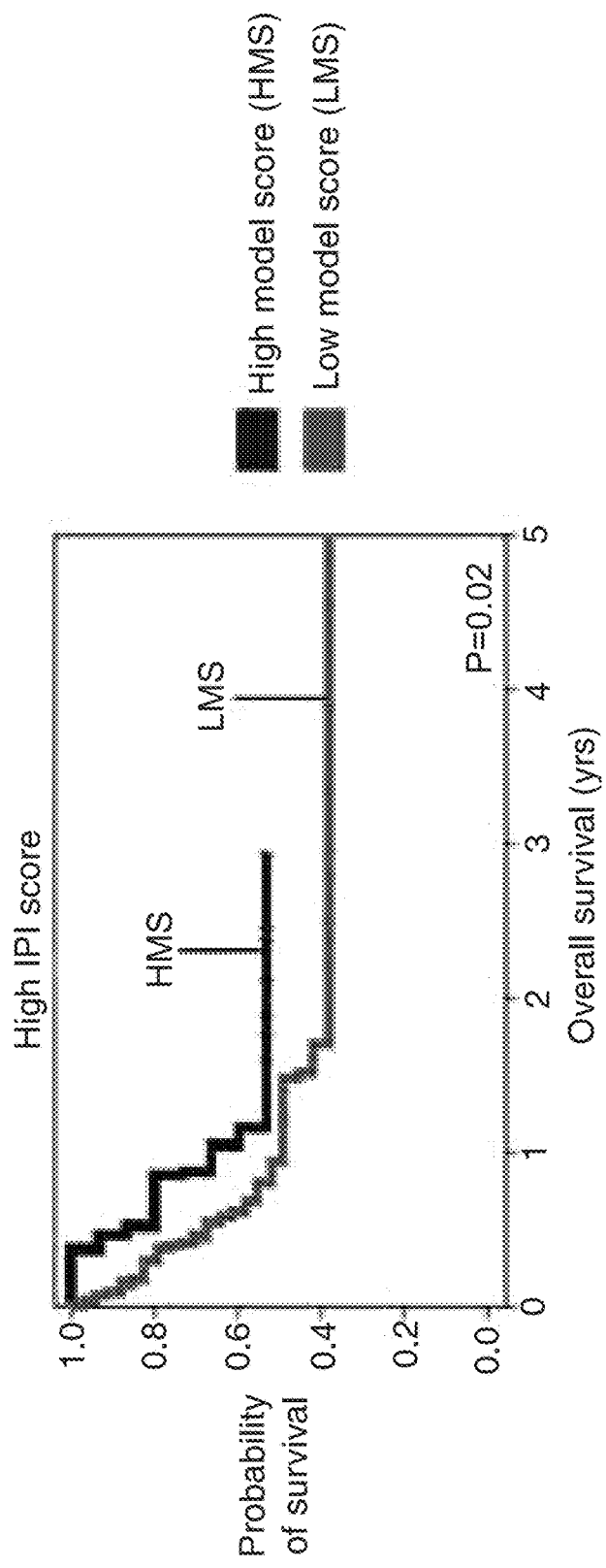
FIG. 10C is a Kaplan-Meier estimates plot depicting the overall survival among high revised International Prognostic Index (IPI) risk group patients stratified according to the gene expression-based outcome predictor. After grouping patients into quartiles according to gene expression-based outcome predictor score, quartiles 1 and 2 were merged (Low Model Score), and quartiles 3 and 4 were merged (High Model Score).

The International Prognostic Index (IPI), which is based on 5 clinical variables, predicts survival in both CHOP-treated and R-CHOP-treated patients (Shipp et al., *N. Engl. J. Med.*, 329:987-94 (1993); Sehn et al., *Blood*, 109: 1857-61 (2007)). The inventive gene expression-based survival model retained its prognostic significance among R-CHOP-treated patients segregated according to IPI into high, intermediate and low IPI risk groups, both as originally defined (Shipp et al., supra) (p<0.001) (FIG. 2C) and as recently modified for R-CHOP-treated DLBCL (Sehn et al., supra) (p<0.001) (FIG. 10).

The foregoing results indicate that the gene expression-based multivariate model can be used to identify large disparities in survival among patients with different DLBCL gene signature profiles. Thus, survival predictor scores were used to divide patients into least and most favorable quartile groups having 3-year progression-free survival rates of 33% and 84%, respectively. Given its statistical independence from the IPI, the gene expression-based survival predictor provides a complementary view of DLBCL variation that can be considered when analyzing data from DLBCL clinical trials. Additionally, the foregoing results indicate that whole-genome gene expression profiles in conjunction with the survival model described herein can be used to provide optimal predictions of expected survival outcomes for subjects suffering from DLBCL.

Example 3

This example demonstrates the use of a survival predictor score to predict the probability of progression free and overall survival outcomes at a period of time t following R-CHOP treatment in accordance with the invention.

RNA is isolated from a patient's DLBCL biopsy and hybridized to a U133+ array from Affymetrix (Santa Clara, Calif.). The array is scanned, and MAS 5.0 algorithm is applied to obtain signal values normalized to a target intensity of 500. Signal values are log 2 transformed to intensity values. For genes of interest with multiple probe sets, the intensity value of the multiple probe sets are averaged to obtain a single intensity value for each gene. The single intensity values of genes in the GCB signature are averaged to obtain a GCB signature average of 9.2. The single intensity values of genes in the stromal-1 signature are averaged to obtain a stromal-1 signature average of 8.5. The single intensity values of genes in the stromal-2 signature are averaged to obtain a stromal-2 signature average of 7.2.

The patient's survival predictor score is calculated using the following equation 8.11−[0.419*(GCB signature average)]−[1.015*(stromal-1 signature average)]+[0.675*(stromal-2 signature average)], such that the survival predictor score=8.11−[0.419*(9.2)]−[1.015*(8.5)]+[0.675*(7.2)]=0.389

Table 4 includes values from a progression free survival curve generated using baseline hazard functions calculated from the R-CHOP patient data described in Table 3. The curve was generated in accordance with the methods of Kalbfleisch and Prentice, *Biometrika*, 60: 267-279 (1973), which involves maximizing the full likelihood, under the assumption that the true scaling coefficients were equal to prior estimates. In Table 4, $F_0(t)$ is the probability of progression free survival for each indicated time period following R-CHOP treatment (t-RCHOP).

TABLE 4

| t-RCHOP (years) | $F_0(t)$ |
|---|---|
| 0.000 | 1.000 |
| 0.008 | 0.997 |
| 0.016 | 0.993 |
| 0.025 | 0.990 |
| 0.030 | 0.987 |
| 0.036 | 0.983 |
| 0.049 | 0.980 |
| 0.082 | 0.977 |
| 0.096 | 0.973 |
| 0.107 | 0.970 |
| 0.118 | 0.967 |
| 0.120 | 0.963 |
| 0.156 | 0.960 |
| 0.156 | 0.956 |
| 0.159 | 0.953 |
| 0.178 | 0.950 |
| 0.192 | 0.946 |
| 0.211 | 0.943 |
| 0.233 | 0.939 |
| 0.241 | 0.936 |
| 0.246 | 0.932 |
| 0.252 | 0.928 |
| 0.290 | 0.925 |
| 0.298 | 0.921 |
| 0.307 | 0.918 |
| 0.364 | 0.914 |
| 0.381 | 0.910 |
| 0.381 | 0.907 |
| 0.400 | 0.903 |
| 0.441 | 0.899 |
| 0.446 | 0.895 |
| 0.463 | 0.891 |
| 0.468 | 0.887 |
| 0.515 | 0.884 |
| 0.517 | 0.880 |
| 0.531 | 0.876 |
| 0.534 | 0.872 |
| 0.537 | 0.868 |
| 0.537 | 0.864 |
| 0.539 | 0.860 |
| 0.561 | 0.856 |
| 0.586 | 0.852 |
| 0.611 | 0.848 |
| 0.679 | 0.843 |
| 0.698 | 0.839 |
| 0.698 | 0.834 |
| 0.720 | 0.830 |
| 0.747 | 0.826 |
| 0.756 | 0.821 |

TABLE 4-continued

| t-RCHOP (years) | $F_0(t)$ |
|---|---|
| 0.761 | 0.816 |
| 0.767 | 0.812 |
| 0.786 | 0.807 |
| 0.849 | 0.803 |
| 0.879 | 0.798 |
| 0.884 | 0.793 |
| 0.898 | 0.789 |
| 0.912 | 0.784 |
| 0.977 | 0.779 |
| 0.986 | 0.774 |
| 1.046 | 0.770 |
| 1.057 | 0.765 |
| 1.076 | 0.760 |
| 1.128 | 0.755 |
| 1.166 | 0.750 |
| 1.216 | 0.745 |
| 1.227 | 0.740 |
| 1.270 | 0.735 |
| 1.481 | 0.729 |
| 1.547 | 0.724 |
| 1.624 | 0.718 |
| 1.900 | 0.711 |
| 1.919 | 0.705 |
| 2.105 | 0.699 |
| 2.231 | 0.692 |
| 2.245 | 0.685 |
| 2.352 | 0.678 |
| 2.546 | 0.671 |
| 2.968 | 0.662 |
| 3.890 | 0.648 |
| 4.364 | 0.623 |

The patient's probability of 2 year progression free survival is calculated using the equation: $P(PFS) = F_0(t)^{(exp(0.976*survival\ predictor\ score))}$, where $F_0(t)$ is the $F_0(t)$ value that corresponds to the largest time value smaller than 2 years in the progression free survival curve. In Table 4, the largest time value smaller than 2 is 1.919, and the corresponding $PF_0(t)$ value is 0.705. Accordingly, the patient's probability of 2 year progression free survival $P(PFS) = 0.705^{(exp(0.976*survival\ predictor\ score))} = 0.705^{1.462} = 0.600$ or about 60%.

Table 5 includes values from an overall survival curve generated using baseline hazard functions calculated from the R-CHOP patient data described in Table 3. The curve was made according to the method of Kalbfleisch and Prentice, *Biometrika*, 60: 267-279 (1973), which involves maximizing the full likelihood, under the assumption that the true scaling coefficients were equal to our estimates. In Table 5, $OS_0(t)$ is the probability of overall survival for each indicated time period following R-CHOP treatment (t-RCHOP).

TABLE 5

| t-RCHOP (years) | $OS_0(t)$ |
|---|---|
| 0.000 | 1.000 |
| 0.008 | 0.997 |
| 0.016 | 0.994 |
| 0.030 | 0.991 |
| 0.033 | 0.988 |
| 0.036 | 0.984 |
| 0.049 | 0.981 |
| 0.082 | 0.978 |
| 0.096 | 0.975 |
| 0.156 | 0.972 |
| 0.156 | 0.969 |
| 0.159 | 0.965 |
| 0.178 | 0.962 |
| 0.192 | 0.959 |
| 0.211 | 0.956 |
| 0.233 | 0.952 |
| 0.246 | 0.949 |
| 0.307 | 0.946 |
| 0.367 | 0.942 |
| 0.380 | 0.939 |
| 0.386 | 0.935 |
| 0.402 | 0.932 |
| 0.416 | 0.928 |
| 0.463 | 0.925 |
| 0.468 | 0.921 |
| 0.504 | 0.918 |
| 0.515 | 0.914 |
| 0.517 | 0.910 |
| 0.531 | 0.907 |
| 0.556 | 0.903 |
| 0.586 | 0.900 |
| 0.610 | 0.896 |
| 0.619 | 0.892 |
| 0.698 | 0.888 |
| 0.747 | 0.885 |
| 0.807 | 0.881 |
| 0.862 | 0.877 |
| 0.868 | 0.873 |
| 0.873 | 0.869 |
| 0.895 | 0.864 |
| 0.944 | 0.860 |
| 0.963 | 0.856 |
| 1.010 | 0.852 |
| 1.057 | 0.848 |
| 1.169 | 0.843 |
| 1.169 | 0.839 |
| 1.215 | 0.835 |
| 1.262 | 0.830 |
| 1.273 | 0.826 |
| 1.382 | 0.821 |
| 1.412 | 0.817 |
| 1.492 | 0.812 |
| 1.527 | 0.807 |
| 1.552 | 0.802 |
| 1.708 | 0.796 |
| 1.889 | 0.791 |
| 2.244 | 0.784 |
| 2.693 | 0.777 |
| 3.826 | 0.763 |
| 3.889 | 0.749 |
| 4.363 | 0.724 |

The patient's probability of 2 year overall survival is calculated using the equation: $P(OS) = OS_0(t)^{(exp(survival\ predictor\ score))}$, where $OS_0(t)$ is the value that corresponds to the largest time value in the overall survival curve which is smaller than 2 years. In Table 5, the largest time value smaller than 2 is 1.889, and the corresponding $OS_0(t)$ value is 0.791. Accordingly, the patient's probability of 2 year overall survival is $P(PFS) = 0.791^{(exp(0.389))} = 0.791^{1.4476} = 0.707$ or 70.7%.

Example 4

This example demonstrates the biological basis for DLBCL prognostic signatures.

Unless otherwise indicated, cohorts and methods of gene expression analysis are described in Examples 1 and 2. Furthermore, cell suspensions from three biopsies were separated by flow cytometry into a CD19+ malignant subpopulation and a CD19− non-malignant subpopulation. Gene expression profiling was performed following two rounds of linear amplification from total RNA (Dave et al., *N. Engl. J. Med.*, 351: 2159-69 (2004)). After MAS5.0 normalization, genes were selected that had a log 2 signal value greater than 7 in either the CD19+ or CD19− fractions in at least two of the sorted samples.

Figure 4A:
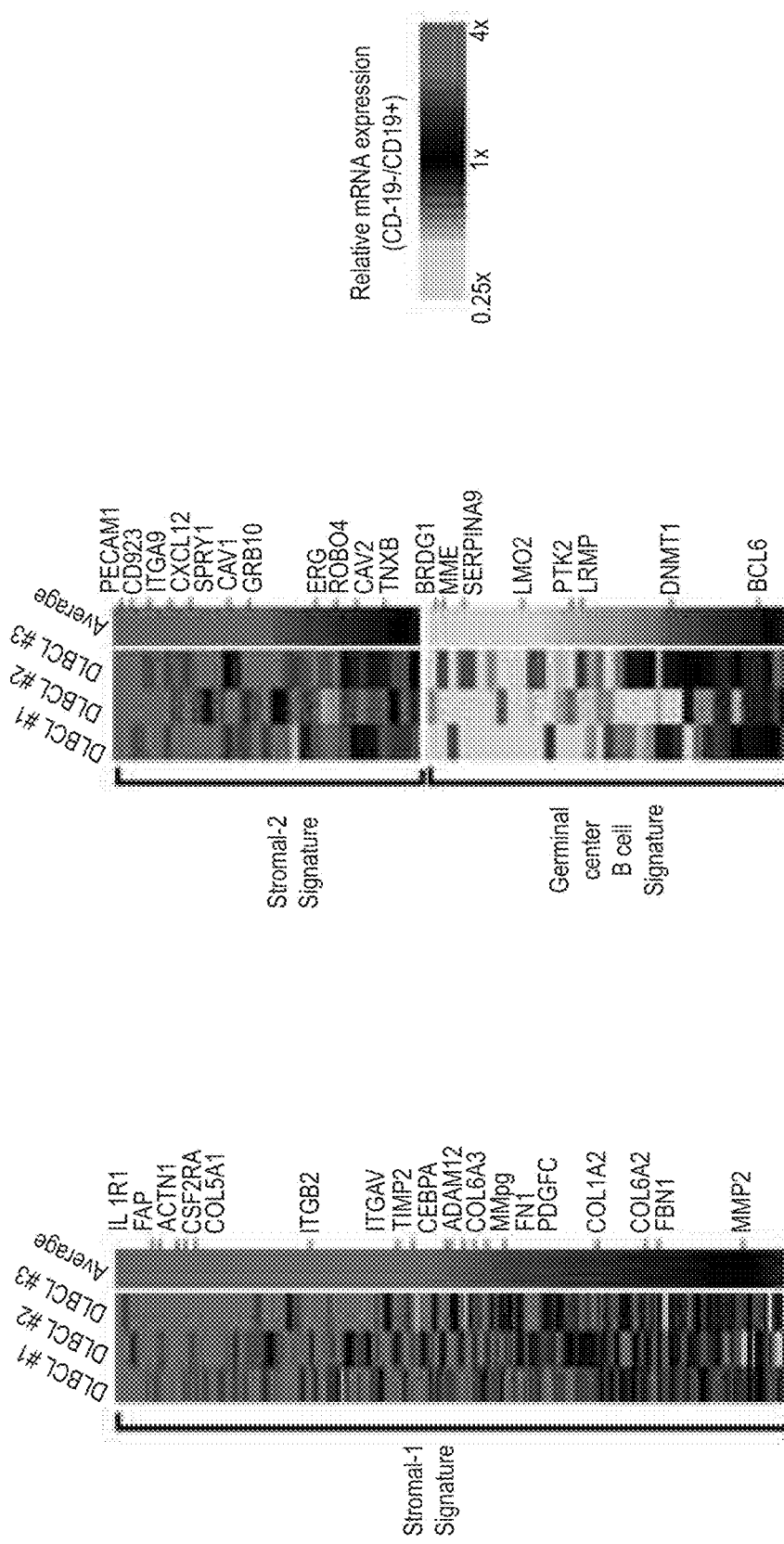
FIG. 4A depicts the relative gene expression of stromal-1, stromal-2, and germinal center B cell signatures in CD19+ malignant and CD19– non-malignant subpopulations of cells isolated from three biopsy specimens from patients with DLBCL. Stromal-1 and stromal-2 signature genes were more highly expressed in the non-malignant cells, whereas the germinal center B cell signature genes were more highly expressed in the malignant cells. The log 2 ratios of gene expression levels in the CD19– subpopulation to those in the CD19+ subpopulations are depicted according to the scale shown.

To assess whether the gene expression signatures in the final survival model of Example 2 were derived from the malignant lymphoma cells or from the host microenvironment, three DLBCL biopsy samples were fractionated into CD19+ malignant cells and CD19− non-malignant cells by flow sorting. Most germinal center B cell signature genes were more highly expressed in the malignant fraction, whereas genes from the stromal-1 and stromal-2 signatures were more highly expressed in the non-malignant stromal fraction (FIG. 4A), hence their name. Since these two signatures were synergistic in predicting survival, they were combined into a "stromal score" (FIG. 3), high values of which were associated with adverse outcome.

The germinal center B cell signature relates to the distinction between the ABC and GCB DLBCL subtypes (FIG. 3). By contrast, the genes defining the stromal-1 signature encodes components of the extracellular matrix, including fibronectin, osteonectin, various collagen and laminin isoforms, and the anti-angiogenic factor thrombospondin (FIG. 3 and Table 1). This signature also encodes modifiers of collagen synthesis (LOXL1, SERPINH1), proteins that remodel the extracellular matrix (MMP2, MMP9, MMP14, PLAU, TIMP2), and CTGF, a secreted protein that can initiate fibrotic responses (Frazier et al., *J. Invest. Dermatol.*, 107(3): 404-11 (1996)). In addition, the stromal-1 signature includes genes characteristically expressed in cells of the monocytic lineage, such as CEBPA and CSF2RA.

Figure 4B:
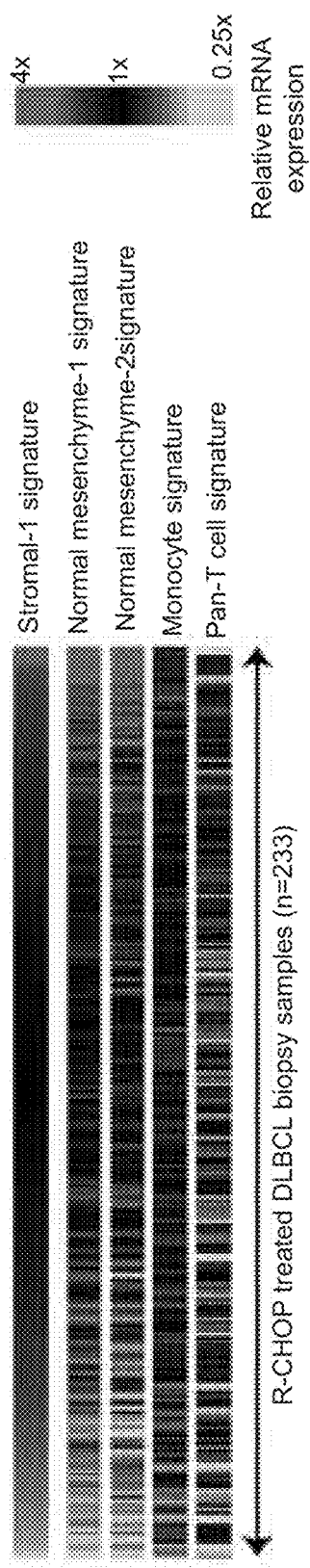
FIG. 4B depicts the results of gene enrichment analysis comparing the stromal-1 gene signature with mesenchyme-1 and mesenchyme-2 signatures (from normal mesenchymal origin cells), with a monocyte signature expressed more highly in normal blood monocytes than in blood B, T, and NK cells, and in a pan-T cell signature expressed more highly in blood T cells than in blood B cells, NK cells, and monocytes. While a relationship was seen between stromal-1 signature and mesenchyme-1, mesenchyme-2, and monocyte signatures, no relationship was observed between the stromal-1 signature and a pan-T cell signature expressed more highly in blood T cells than in blood B cells, NK cells, and monocytes. The relative levels of gene expression are depicted according to the scale shown.
Figure 11:
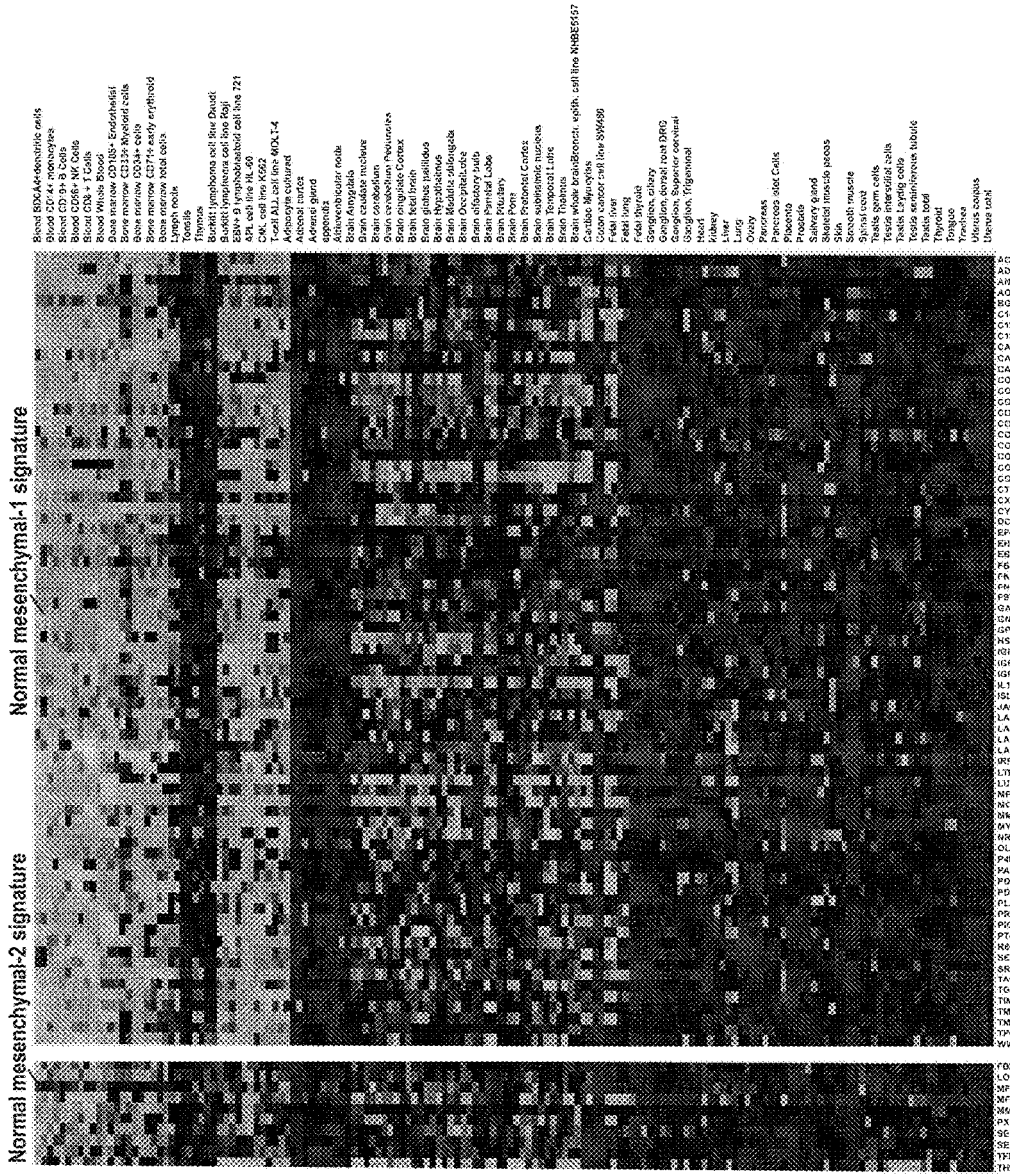
FIG. 11 depicts normal mesenchymal-1 and normal mesenchymal-2 signature gene expression in various normal tissues.

The stromal-1 signature is significantly related to several previously curated gene expression signatures (Shaffer et al., *Immunol. Rev.*, 210: 67-85 (2006)) based on gene set enrichment analysis (Subramanian et al., *Proc. Nat'l. Acad. Sci. USA*, 102(43): 15545-50 (2005)). Two of these signatures include genes that are coordinately expressed in normal mesenchymal tissues but not in hematopoietic subsets, many of which encode extracellular matrix proteins (false discovery rate (FDR)<0.001) (FIGS. 4B and 11) (Su et al., *Proc. Nat'l. Acad. Sci. USA*, 101: 6062-7 (2004)). Also enriched was a "monocyte" signature, comprised of genes that are more highly expressed in CD14+ blood monocytes than in B cells, T cells, or NK cells (FDR=0.014) (FIG. 4B). By contrast, a pan-T cell signature was not related to the stromal-1 signature (FIG. 4B). These findings suggest that high expression of the stromal-1 signature identifies tumors with vigorous extracellular matrix deposition and infiltration by cells in the monocytic lineage.

Figure 5A:
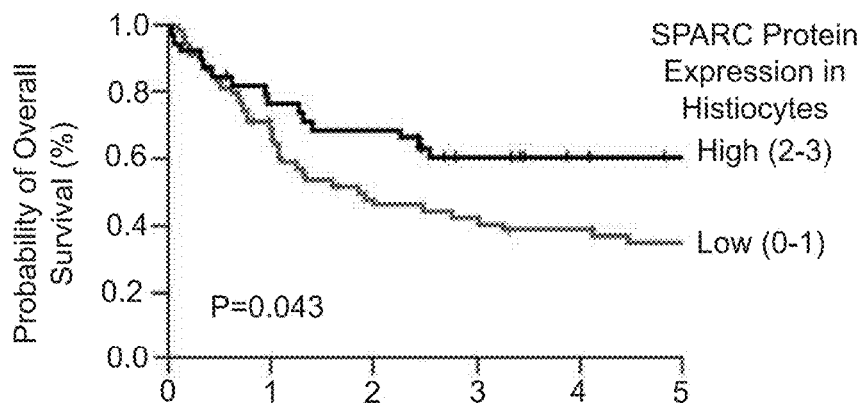
FIG. 5A is a Kaplan-Meier estimates plot depicting the probability of overall survival versus time (in years) in DLBCL cases segregated according to SPARC protein expression levels, as indicated.

In this regard, the stromal-1 signature gene product fibronectin was prominently localized by immunohistochemistry to fibrous strands running between the malignant cells in DLBCL biopsy samples, in keeping with its role in extracellular matrix formation. By contrast, the protein products of three other stromal-1 genes—MMP9, SPARC, and CTGF—were localized primarily in histiocytic cells that infiltrated the DLBCL biopsies. By immunofluorescence, SPARC and CTGF colocalized with CD68, which is a marker for cells in the monocytic lineage. As expected for a stromal-1 gene product, SPARC protein levels were associated with favorable overall survival (FIG. 5A).

The stromal-1 signature includes genes that are coordinately expressed in many normal mesenchymal tissues, most of which encode proteins that form or modify the extracellular matrix. The localization of fibronectin to fibrous strands insinuated between the malignant lymphoma cells suggests that the stromal-1 signature reflects the fibrotic nature of many DLBCL tumors. This fibrotic reaction may be related to another stromal-1 signature component, CTGF, which participates in many fibrotic responses and diseases, and promotes tumor growth and metastasis of epithelial cancers (Shi-Wen et al., *Cytokine Growth Factor Rev.*, 19: 133-44 (2008)).

The foregoing results also indicate that the stromal-1 signature reflects a monocyte-rich host reaction to the lymphoma that is associated with the abundant deposition of extracellular matrix. Tumors with high expression of the stromal-1 signature were infiltrated by cells of the myeloid lineage, which include cells that have been implicated in the pathogenesis of epithelial cancers, including tumor-associated macrophages, myeloid-derived suppressor cells, and Tie2-expressing monocytes (reviewed in Wels et al., *Genes Dev.*, 22: 559-74 (2008)). In animal models, these myeloid lineage cells promote tumor cell invasion by secreting matrix metalloproteinases such as MMP9, suppress T cell immune responses, and initiate angiogenesis.

Several stromal-2 signature genes encode well-known markers of endothelial cells. These include von-Willebrand factor (VWF) and CD31 (PECAM1), as well as other genes specifically expressed in endothelium such as EGFL7, MMRN2, GPR116, and SPARCL (Table 1). This signature also includes genes encoding key regulators of angiogenesis, such as, for example, KDR (VEGF receptor-2); Grb10, which mediates KDR signaling; integrin alpha 9, which enhances VEGF signaling; TEK, the receptor tyrosine kinase for the cytokine angiopoietin; ROBO4, an endothelial-specific molecular guidance molecule that regulates angiogenesis; and ERG, a transcription factor required for endothelial tube formation. The stromal-2 signature genes CAV1, CAV2, and EHD2 encode components of caveolae, which are specialized plasma membrane structures that are abundant in endothelial cells and required for angiogenesis (Frank et al., *Arterioscler. Thromb. Vasc. Biol.*, 23: 1161-8 (2003); Woodman et al., *Am. J. Pathol.*, 162: 2059-68 (2003)). Although the stromal-2 signature includes a large number of genes expressed in endothelial cells, other genes are expressed exclusively in adipocytes, including ADIPOQ, FABP4, RBP4, and PLIN.

Figure 5B:
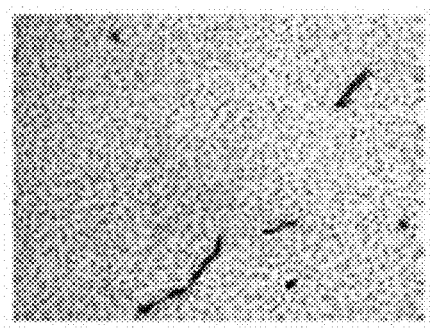
FIG. 5B is a pair of images showing the identification of tumor blood vessels by immunohistochemical analysis of CD34+ endothelial cells in representative DLBCL biopsies having low or high blood vessel density (CD34+ objects/$\mu M^2$), as indicated.
Figure 5B:
Figure 5C:
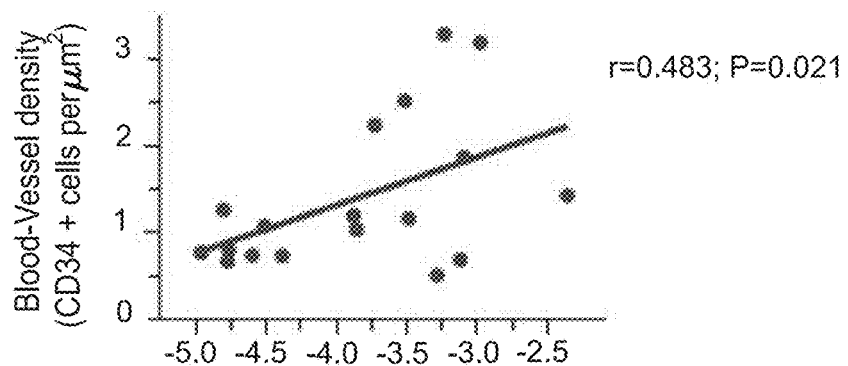
FIG. 5C is a plot depicting the correlation between the tumor blood vessel density and the stromal score in analyzed DLBCL biopsies.

Quantitative tests were done to determine whether expression of the stromal-2 signature relative to the stromal-1 signature (i.e., high stromal score) is related to high tumor blood vessel density, given the connection between many stromal-2 signature genes and angiogenesis. More specifically, the stromal-1 signature averages were subtracted from the stromal-2 signature average to thereby obtain a stromal score for each biopsy. Tests showed a quantitative measure of blood vessel density correlated significantly with the stromal score (r=0.483, p=0.019) (see FIGS. 5B and 5C), such that higher blood vessel densities correlated with higher stromal scores.

Thus, the stromal-1 and stromal-2 gene expression signatures reflect the character of the non-malignant cells in DLBCL tumors, and the stromal-2 signature may represent an "angiogenic switch" in which the progression of a hyperplastic lesion to a fully malignant tumor is accompanied by new blood vessel formation (Hanahan et al., *Cell*, 86: 353-64 (1996)). DLBCL tumors with high relative expression of the stromal-2 signature were associated with increased tumor blood vessel density and adverse survival. Significant macrophage infiltration in some DLBCL tumors may predispose to angiogenesis since, in experimental models, tumor-associated macrophages accumulate prior to the angiogenic switch and are required for the switch to occur (Lin et al., *Cancer Res.*, 66: 11238-46 (2006)). Additionally, CXCL12 (SDF-1), a stromal-2 signature component, is a chemokine secreted either by fibroblasts or endothelial cells that can promote angiogenesis by recruiting CXCR4+ endothelial precursor cells from the bone marrow (Orimo et al., *Cell,* 121: 335-48 (2005)). Moreover, an antagonist of angiogenesis, thrombospondin-2 (Kazerounian et al., *Cell Mol. Life Sci.,* 65: 700-12 (2008)), is a stromal-1 signature component, which may explain why tumors with low relative expression of this signature had an elevated blood vessel density. Furthermore, the expression of adipocyte-associated genes in DLBCL tumors with high stromal-2 signature expression may play a role in angiogenesis since some cells in adipose tissue may have the potential to differentiate into endothelial cells (Planat-Benard et al., *Circulation,* 109: 656-63 (2004)). Alternatively, the expression of adipose-associated genes may reflect the recruitment of bone marrow-derived mesenchymal stem cells, which home efficiently to tumors (Karnoub et al., *Nature,* 449: 557-63 (2007)) and can stabilize newly formed blood vessels (Au et al., *Blood,* 111: 4551-4558 (2008)).

The foregoing results indicate that the stromal-1 and stromal-2 gene signatures can be used to generate a stromal score that correlates with increased blood vessel density. Thus, the stromal score can be used to determine if a DLBCL patient is likely to benefit from administration of antiangiogenic therapy (alone, or in conjunction with another DLBCL therapeutic regimen).

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Preferred embodiments of this invention are described herein, including the best mode known to the inventors for carrying out the invention. Variations of those preferred embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (4768 sequences)

SEQ ID NO: 1 - DNA, 567 bp, Artificial sequence
  Target_Sequence, Fragment of GenBank Accession No. NM_052932
cagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttag

SEQ ID NO: 2 - DNA, 25 bp, Artificial sequence
  Affy probe set ID: 211967_at
cagaacttcgtagaccgacctgaag

SEQ ID NO: 3 - DNA, 25 bp, Artificial sequence
  Affy probe set ID: 211967_at
tcgtagaccgacctgaagtttcttt

SEQ ID NO: 4 - DNA, 25 bp, Artificial sequence
  Affy probe set ID: 211967_at
aatacttgtttctttagcactttga

SEQ ID NO: 5 - DNA, 25 bp, Artificial sequence
  Affy probe set ID: 211967_at
ccttgaaagtttcctctgcattggg

SEQ ID NO: 6 - DNA, 25 bp, Artificial sequence
  Affy probe set ID: 211967_at
gtttcctctgcattgggtttgaagt

SEQ ID NO: 7 - DNA, 25 bp, Artificial sequence
  Affy probe set ID: 211967_at
tgtctttttctctgtatgtaagtag

SEQ ID NO: 8 - DNA, 25 bp, Artificial sequence
  Affy probe set ID: 211967_at
caaatacccgtactttgaatgtagg

SEQ ID NO: 9 - DNA, 25 bp, Artificial sequence
  Affy probe set ID: 211967_at
attttgctttggaccatatttctta

SEQ ID NO: 10 - DNA, 25 bp, Artificial sequence
  Affy probe set ID: 211967_at
aaaatttccttgaataatccatgaa

SEQ ID NO: 11 - DNA, 25 bp, Artificial sequence
  Affy probe set ID: 211967_at
taatgaccagcttttggtatttcat

SEQ ID NO: 12 - DNA, 25 bp, Artificial sequence
  Affy probe set ID: 211967_at
cattgttaccaagttctatttttag

SEQ ID NO: 13 - DNA, 489 bp, Artificial sequence
  Target_Sequence, Fragment of GenBank Accession No. NM_001014380
  misc_feature (91)..(91): n is a, c, g, or t
atggtcagcttcattatttggatgtattgcattcaaagcagcagttccaaacataacacacatctattttcttagagttttgtaaatacanactaacctgatgacattaaaaattgtggatcctacatgttcctatgttcattctctaaaaacctgagtaactttatgaaaacacacaaacctggaaaaacatcacatttttgtcacatttttactgacaaatgtatattcatatgatggtacggcagcagggagtggcccccagttaacatggctgtgagtggacacagtgtctcgcaggatcactgcatgttatgatggcttgtaagtgcgttgttaagacttttgtttcagtgtttgtctcccagtatttgaacctaatttaaagaaaaagacgtttccaagttgtatttattaaatgtgtttttccttaccttttgtgctgctactttgctaatctcattagcttagctgtgtttgtgcataggt

SEQ ID NO: 14 - DNA, 25 bp, Artificial sequence
  Affy probe set ID: 227713_at
atggtcagcttcattatttggatgt

SEQ ID NO: 15 - DNA, 25 bp, Artificial sequence
  Affy probe set ID: 227713_at
agcagcagttccaaacataacacac

SEQ ID NO: 16 - DNA, 25 bp, Artificial sequence
  Affy probe set ID: 227713_at
aattgtggatcctacatgttcctat

SEQ ID NO: 17 - DNA, 25 bp, Artificial sequence
  Affy probe set ID: 227713_at
catgttcctatgttcattctctaaa

SEQ ID NO: 18 - DNA, 25 bp, Artificial sequence
  Affy probe set ID: 227713_at
tggtacggcagcagggagtggcccc

SEQ ID NO: 19 - DNA, 25 bp, Artificial sequence
  Affy probe set ID: 227713_at
tggcccccagttaacatggctgtga

SEQ ID NO: 20 - DNA, 25 bp, Artificial sequence
  Affy probe set ID: 227713_at
tggacacagtgtctcgcaggatcac

SEQ ID NO: 21 - DNA, 25 bp, Artificial sequence
  Affy probe set ID: 227713_at
tcagtgtttgtctcccagtatttga

SEQ ID NO: 22 - DNA, 25 bp, Artificial sequence
  Affy probe set ID: 227713_at
cttaccttttgtgctgctactttgc

SEQ ID NO: 23 - DNA, 25 bp, Artificial sequence
  Affy probe set ID: 227713_at
tgctgctactttgctaatctcatta

SEQ ID NO: 24 - DNA, 25 bp, Artificial sequence
  Affy probe set ID: 227713_at
agcttagctgtgtttgtgcataggt

SEQ ID NO: 25 - DNA, 562 bp, Artificial sequence
  Target_Sequence, Fragment of GenBank Accession No. NM_004665
ggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttataggggcgtctctttatcactcagcttctgcatcatacgcttggctgaatgtgtttatcggcttcccaagaaactttgaagggctatttcagtagtatagaccagtgagtcctaaatattttttctcatcaataattattttttaagtattatgataatgttgtccatttttttcggctactctgaaatgttgcagtgtggaacaatggaaagagcctgggtgtttgggtcagataaatgaagatcaaactccagctccagcctcattttgcttgagacttttgtgtgtatgggggacttgtatgtatgggagtgaggagtttcagggccattgaaacatagctgtgcccttgaagagaatagtaatgatgggaatttagaggtttatgactgaattccctttgac

SEQ ID NO: 26 - DNA, 25 bp, Artificial sequence
  Affy probe set ID: 205922_at
ggatcatctgggcctatactaacag

SEQ ID NO: 27 - DNA, 25 bp, Artificial sequence
  Affy probe set ID: 205922_at
gtgggaccagcaattcagcaataac

SEQ ID NO: 28 - DNA, 25 bp, Artificial sequence
  Affy probe set ID: 205922_at
gttataggggcgtctctttatcact

SEQ ID NO: 29 - DNA, 25 bp, Artificial sequence
  Affy probe set ID: 205922_at
ctttatcactcagcttctgcatcat

SEQ ID NO: 30 - DNA, 25 bp, Artificial sequence
  Affy probe set ID: 205922_at
cttctgcatcatacgcttggctgaa

SEQ ID NO: 31 - DNA, 25 bp, Artificial sequence
  Affy probe set ID: 205922_at
ggctgaatgtgtttatcggcttccc

SEQ ID NO: 32 - DNA, 25 bp, Artificial sequence
  Affy probe set ID: 205922_at
aatgaagatcaaactccagctccag

SEQ ID NO: 33 - DNA, 25 bp, Artificial sequence
  Affy probe set ID: 205922_at
ccagcctcattttgcttgagacttt

SEQ ID NO: 34 - DNA, 25 bp, Artificial sequence
  Affy probe set ID: 205922_at
gggagtgaggagtttcagggccatt

SEQ ID NO: 35 - DNA, 25 bp, Artificial sequence
  Affy probe set ID: 205922_at
gccattgaaacatagctgtgccctt

SEQ ID NO: 36 - DNA, 25 bp, Artificial sequence
  Affy probe set ID: 205922_at
ggtttatgactgaattccctttgac

SEQ ID NO: 37 - DNA, 512 bp, Artificial sequence
  Target_Sequence, Fragment of GenBank Accession No. NM_004760
  misc_feature (77)..(77): n is a, c, g, or t
  misc_feature (274)..(274): n is a, c, g, or t
  misc_feature (422)..(422): n is a, c, g, or t
actagaagaagcaaatgccctccaagaaggtcattctgtgcctgaaattaattcggataccgacaaatcagaaaccnaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacantgaaaatgttaatattatttatggacctctggccaaatggtacatgtactggaagtggataaccagtatcacttacacaaacaaaaataactttgtcaaatttgtggagttaggtggaagccagattttaaaagttgccaaccagganatttaacaggtacagttacccgtttcaatgttatttttaagaagggagatgttggcacctttgaattctacatcctgtttctccagaatg

SEQ ID NO: 38 - DNA, 25 bp, Artificial sequence
  Affy probe set ID: 202693_s_at
actagaagaagcaaatgccctccaa

SEQ ID NO: 39 - DNA, 25 bp, Artificial sequence
  Affy probe set ID: 202693_s_at
aaggtcattctgtgcctgaaattaa

SEQ ID NO: 40 - DNA, 25 bp, Artificial sequence
  Affy probe set ID: 202693_s_at
aggaatccattgtaaccgaagagtt

SEQ ID NO: 41 - DNA, 25 bp, Artificial sequence
  Affy probe set ID: 202693_s_at
gttacttcatatactctaggacaat

SEQ ID NO: 42 - DNA, 25 bp, Artificial sequence
  Affy probe set ID: 202693_s_at
atctactgagcaatatttcccttta

SEQ ID NO: 43 - DNA, 25 bp, Artificial sequence
  Affy probe set ID: 202693_s_at
taatattatttatggacctctggcc

SEQ ID NO: 44 - DNA, 25 bp, Artificial sequence
  Affy probe set ID: 202693_s_at
cctctggccaaatggtacatgtact

SEQ ID NO: 45 - DNA, 25 bp, Artificial sequence
  Affy probe set ID: 202693_s_at
gtggataaccagtatcacttacaca

SEQ ID NO: 46 - DNA, 25 bp, Artificial sequence
  Affy probe set ID: 202693_s_at
gtacagttacccgtttcaatgttat

SEQ ID NO: 47 - DNA, 25 bp, Artificial sequence
  Affy probe set ID: 202693_s_at
gttggcacctttgaattctacatcc

SEQ ID NO: 48 - DNA, 25 bp, Artificial sequence
  Affy probe set ID: 202693_s_at
ttctacatcctgtttctccagaatg

SEQ ID NO: 49 - DNA, 521 bp, Artificial sequence
  Target_Sequence, Fragment of GenBank Accession No. CR590554
  misc_feature (47)..(47): n is a, c, g, or t
  misc_feature (53)..(53): n is a, c, g, or t
  misc_feature (64)..(64): n is a, c, g, or t
  misc_feature (98)..(98): n is a, c, g, or t
catctggcaaatctgggactctatacccattaaacaactcccatttncccctnccccacagccntggcaaccatcattctacttttctctatgaattncactactttagatacctcatataaatggaatcatacaggatttgtccttttgtagctgacatatttcacttaacataatgtcctcaaggttcatccatattgtagaatgtgataggatttcctgccattttaaggctgaataatattccactgcatgtatttaccacatttttttatccattcatctgttggtggacgtttgggttgcctccatctcttggctattgtgaataatgctgctgtaaacatgagtgtgcaaatatctataattttttaacacagtactttattttcggtatttaatcatatggaatttttgtcaattatgttaaaggattttacaacaacccaactatagatttatatatatatgtattattgttgttccttctaagcttaagaagtctctaataaaatccatac

SEQ ID NO: 50 - DNA, 25 bp, Artificial sequence
  Affy probe set ID: 228464_at
catctggcaaatctgggactctata

SEQ ID NO: 51 - DNA, 25 bp, Artificial sequence
  Affy probe set ID: 228464_at
aatctgggactctatacccattaaa

SEQ ID NO: 52 - DNA, 25 bp, Artificial sequence
  Affy probe set ID: 228464_at
cactactttagatacctcatataaa

SEQ ID NO: 53 - DNA, 25 bp, Artificial sequence
  Affy probe set ID: 228464_at
aatgtgataggatttcctgccattt

SEQ ID NO: 54 - DNA, 25 bp, Artificial sequence
  Affy probe set ID: 228464_at
aggatttcctgccattttaaggctg

SEQ ID NO: 55 - DNA, 25 bp, Artificial sequence
  Affy probe set ID: 228464_at
atattccactgcatgtatttaccac

SEQ ID NO: 56 - DNA, 25 bp, Artificial sequence
  Affy probe set ID: 228464_at
attcatctgttggtggacgtttggg

SEQ ID NO: 57 - DNA, 25 bp, Artificial sequence
  Affy probe set ID: 228464_at
ttggtggacgtttgggttgcctcca

SEQ ID NO: 58 - DNA, 25 bp, Artificial sequence
  Affy probe set ID: 228464_at
ggattttacaacaacccaactatag

SEQ ID NO: 59 - DNA, 25 bp, Artificial sequence
  Affy probe set ID: 228464_at
gtattattgttgttccttctaagct

SEQ ID NO: 60 - DNA, 25 bp, Artificial sequence
  Affy probe set ID: 228464_at
aagaagtctctaataaaatccatac

SEQ ID NO: 61 - DNA, 466 bp, Artificial sequence
  Target_Sequence, Fragment of GenBank Accession No. NM_017599
  misc_feature (156)..(156): n is a, c, g, or t
tcacttatttagtttaccgacttcatttttctttggatttagaagaagcaattatggaaaaacttggtaatctctctcaacctataaccttacacaggaagaattagagtttaataatttttaattcttttattgtatgttacttttattacaccnagtttgggggaaaatcttcataaaattgtatcagttttattcagtgttctctaaggtgataccttttaattttgaaagactaaataattttaatcgagaatttccagtctttcagtctgatctatttaattcactacttgttacataatccagtgaaaactctacttgttgaaattatgacataaagatcttgcagctttatttgagtatttgttcttttgtgtagtttccatcttttaaaatatttaaaatattttcaagataaagtattatcttctctgcaaaaattcctggagtaattttctctcat

SEQ ID NO: 62 - DNA, 25 bp, Artificial sequence
  Affy probe set ID: 223089_at
tcacttatttagtttaccgacttca

SEQ ID NO: 63 - DNA, 25 bp, Artificial sequence
  Affy probe set ID: 223089_at
taccgacttcatttttctttggatt

SEQ ID NO: 64 - DNA, 25 bp, Artificial sequence
  Affy probe set ID: 223089_at
aaaacttggtaatctctctcaacct

SEQ ID NO: 65 - DNA, 25 bp, Artificial sequence
  Affy probe set ID: 223089_at
tctctcaacctataaccttacacag

SEQ ID NO: 66 - DNA, 25 bp, Artificial sequence
  Affy probe set ID: 223089_at
gtatcagttttattcagtgttctct

SEQ ID NO: 67 - DNA, 25 bp, Artificial sequence
  Affy probe set ID: 223089_at
taatcgagaatttccagtctttcag

SEQ ID NO: 68 - DNA, 25 bp, Artificial sequence
  Affy probe set ID: 223089_at
ttccagtctttcagtctgatctatt

SEQ ID NO: 69 - DNA, 25 bp, Artificial sequence
  Affy probe set ID: 223089_at
gtctgatctatttaattcactactt

SEQ ID NO: 70 - DNA, 25 bp, Artificial sequence
  Affy probe set ID: 223089_at
atcttgcagctttatttgagtattt

SEQ ID NO: 71 - DNA, 25 bp, Artificial sequence
  Affy probe set ID: 223089_at
gttcttttgtgtagtttccatcttt

SEQ ID NO: 72 - DNA, 25 bp, Artificial sequence
  Affy probe set ID: 223089_at
aattcctggagtaattttctctcat

SEQ ID NO: 73 - DNA, 217 bp, Artificial sequence
  Target_Sequence, Fragment of GenBank Accession No. NM_018351
atgctgcaagtgaggtaagatctgaaatctaaagatgagtaatttggggttttgtaatgccaactgcaagtaattacaatattttaaaaatccatttattttacataagattttttgctttgcttttggatgggggaggtgttgttgctgttatttttaatgtgaacagtgttcttgctttgtacctggagagctctttctcaaatgtgttaggaat

SEQ ID NO: 74 - DNA, 25 bp, Artificial sequence
  Affy probe set ID: 1555136_at
atgctgcaagtgaggtaagatctga

SEQ ID NO: 75 - DNA, 25 bp, Artificial sequence
  Affy probe set ID: 1555136_at
gcaagtgaggtaagatctgaaatct

SEQ ID NO: 76 - DNA, 25 bp, Artificial sequence
  Affy probe set ID: 1555136_at
ttgtaatgccaactgcaagtaatta

SEQ ID NO: 77 - DNA, 25 bp, Artificial sequence
  Affy probe set ID: 1555136_at
tgccaactgcaagtaattacaatat

SEQ ID NO: 78 - DNA, 25 bp, Artificial sequence
  Affy probe set ID: 1555136_at
gtgaacagtgttcttgctttgtacc

SEQ ID NO: 79 - DNA, 25 bp, Artificial sequence
  Affy probe set ID: 1555136_at
aacagtgttcttgctttgtacctgg

SEQ ID NO: 80 - DNA, 25 bp, Artificial sequence
  Affy probe set ID: 1555136_at
agtgttcttgctttgtacctggaga

SEQ ID NO: 81 - DNA, 25 bp, Artificial sequence
  Affy probe set ID: 1555136_at
gttcttgctttgtacctggagagct

SEQ ID NO: 82 - DNA, 25 bp, Artificial sequence
  Affy probe set ID: 1555136_at
tgctttgtacctggagagctctttc

SEQ ID NO: 83 - DNA, 25 bp, Artificial sequence
  Affy probe set ID: 1555136_at
gagctctttctcaaatgtgttagga

SEQ ID NO: 84 - DNA, 25 bp, Artificial sequence
  Affy probe set ID: 1555136_at
gctctttctcaaatgtgttaggaat

SEQ ID NO: 85 - DNA, 488 bp, Artificial sequence
  Target_Sequence, Fragment of GenBank Accession No. NM_001007075
ttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgt

SEQ ID NO: 86 - DNA, 25 bp, Artificial sequence
  Affy probe set ID: 226001_at
ttaaatattcattccattacatcta

SEQ ID NO: 87 - DNA, 25 bp, Artificial sequence
  Affy probe set ID: 226001_at
attccattacatctagactcaccaa

SEQ ID NO: 88 - DNA, 25 bp, Artificial sequence
  Affy probe set ID: 226001_at
gactcaccaagaactacatgttatg

SEQ ID NO: 89 - DNA, 25 bp, Artificial sequence
  Affy probe set ID: 226001_at
tataccctataatctttcacctaat

SEQ ID NO: 90 - DNA, 25 bp, Artificial sequence
  Affy probe set ID: 226001_at
ttggatatccttatgttctcaagtc

SEQ ID NO: 91 - DNA, 25 bp, Artificial sequence
  Affy probe set ID: 226001_at
atccttatgttctcaagtctgtatc

SEQ ID NO: 92 - DNA, 25 bp, Artificial sequence
  Affy probe set ID: 226001_at
tttgccacagttaacccattgtgct

SEQ ID NO: 93 - DNA, 25 bp, Artificial sequence
  Affy probe set ID: 226001_at
aacccattgtgcttctttgtaatca

SEQ ID NO: 94 - DNA, 25 bp, Artificial sequence
  Affy probe set ID: 226001_at
aaacagtttgtgggagaatgggctt

SEQ ID NO: 95 - DNA, 25 bp, Artificial sequence
  Affy probe set ID: 226001_at
tgttattactctcagtgaattgtta

SEQ ID NO: 96 - DNA, 25 bp, Artificial sequence
  Affy probe set ID: 226001_at
aatgcactgggcagtaacattttgt

SEQ ID NO: 97 - DNA, 473 bp, Artificial sequence
  Target_Sequence, Fragment of GenBank Accession No. NM_004845
  misc_feature (65)..(65): n is a, c, g, or t
  misc_feature (87)..(88): n is a, c, g, or t
  misc_feature (109)..(109): n is a, c, g, or t
  misc_feature (111)..(111): n is a, c, g, or t
  misc_feature (127)..(127): n is a, c, g, or t
agttccttacttgtgctgatttttcatcataactccttgacctcataaaagcggtgtctaaactnggaacagctgctaatagggtannaagtattatacatcaaataanangttcattacaatattntgtactcataagtcaaaatctgacctggttcgctttgtgcctctgtcagcctacttacagtgataaatgtacacacaagtccagtgttgccaaggagctttgtttatagaaagaagcttggtcccctcagttctatgctgttgtgtggcctggttggtacatgccgtcatgatgaaggatgactttggtttgagataatttgtcactccacattccatggagaaaagtgtttcattttgatgttggaaaaacatgaccagagaagcatgtgactcagataatgttccccggaagttgcagagcaatctgtggtgtctgtcatagcccaactagtcctggagcacat

SEQ ID NO: 98 - DNA, 25 bp, Artificial sequence
  Affy probe set ID: 228959_at
agttccttacttgtgctgatttttc

SEQ ID NO: 99 - DNA, 25 bp, Artificial sequence
  Affy probe set ID: 228959_at
aaatctgacctggttcgctttgtgc

SEQ ID NO: 100 - DNA, 25 bp, Artificial sequence
  Affy probe set ID: 228959_at
cctctgtcagcctacttacagtgat

SEQ ID NO: 101 - DNA, 25 bp, Artificial sequence
  Affy probe set ID: 228959_at
gtacacacaagtccagtgttgccaa

SEQ ID NO: 102 - DNA, 25 bp, Artificial sequence
  Affy probe set ID: 228959_at
tatagaaagaagcttggtcccctca

SEQ ID NO: 103 - DNA, 25 bp, Artificial sequence
  Affy probe set ID: 228959_at
tcccctcagttctatgctgttgtgt

SEQ ID NO: 104 - DNA, 25 bp, Artificial sequence
  Affy probe set ID: 228959_at
tgtggcctggttggtacatgccgtc

SEQ ID NO: 105 - DNA, 25 bp, Artificial sequence
  Affy probe set ID: 228959_at
tgtgactcagataatgttccccgga

SEQ ID NO: 106 - DNA, 25 bp, Artificial sequence
  Affy probe set ID: 228959_at
gttccccggaagttgcagagcaatc

SEQ ID NO: 107 - DNA, 25 bp, Artificial sequence
  Affy probe set ID: 228959_at
tgtggtgtctgtcatagcccaacta

SEQ ID NO: 108 - DNA, 25 bp, Artificial sequence
  Affy probe set ID: 228959_at
tagcccaactagtcctggagcacat

SEQ ID NO: 109 - DNA, 356 bp, Artificial sequence
  Target_Sequence, Fragment of GenBank Accession No. AK026881
  misc_feature (321)..(321): n is a, c, g, or t
ttagcaccttctatccctaaggacaacttactcgtttgagatttctggcagggtaccttgcatgcagtggacactcagtatttgctgaattaaattccttcctatggatcccttctgattttttttaagtgcctctaatacacatatcattctagggctcatgccacttttaatgtcattttctaaaggaaaatcttatctatgatattttcccttataagagatagttgttttgagtagggttttttaaaagataaaggtagtaggaaattttttaaagcctaaatatcaaattcctttccctttggagttgggggaagnaatgaagggggagcaacttgctctttcatatgagt

SEQ ID NO: 110 - DNA, 25 bp, Artificial sequence
  Affy probe set ID: 226799_at
ttagcaccttctatccctaaggaca

SEQ ID NO: 111 - DNA, 25 bp, Artificial sequence
  Affy probe set ID: 226799_at
ggacaacttactcgtttgagatttc

SEQ ID NO: 112 - DNA, 25 bp, Artificial sequence
  Affy probe set ID: 226799_at
gagatttctggcagggtaccttgca

SEQ ID NO: 113 - DNA, 25 bp, Artificial sequence
  Affy probe set ID: 226799_at
ggtaccttgcatgcagtggacactc

SEQ ID NO: 114 - DNA, 25 bp, Artificial sequence
  Affy probe set ID: 226799_at
tgcagtggacactcagtatttgctg

SEQ ID NO: 115 - DNA, 25 bp, Artificial sequence
  Affy probe set ID: 226799_at
taaattccttcctatggatcccttc

SEQ ID NO: 116 - DNA, 25 bp, Artificial sequence
  Affy probe set ID: 226799_at
ttcctatggatcccttctgattttt

SEQ ID NO: 117 - DNA, 25 bp, Artificial sequence
  Affy probe set ID: 226799_at
atacacatatcattctagggctcat

SEQ ID NO: 118 - DNA, 25 bp, Artificial sequence
  Affy probe set ID: 226799_at
gggctcatgccacttttaatgtcat

SEQ ID NO: 119 - DNA, 25 bp, Artificial sequence
  Affy probe set ID: 226799_at
gcctaaatatcaaattcctttccct

SEQ ID NO: 120 - DNA, 25 bp, Artificial sequence
  Affy probe set ID: 226799_at
gagcaacttgctctttcatatgagt

SEQ ID NO: 121 - DNA, 430 bp, Artificial sequence
  Target_Sequence, Fragment of GenBank Accession No. NM_018440
atccctgtattcatggcttgactttgtgactgctctacactgcatgtctgacattgcagagtgagctatgttgaggtaaactggttggttgtcattattttgcaatcagcctggtctctcccatgaagatgtcgtgtgcataagcacaatcatcactgattagaagatcacagcagaatacccttggattagagagaagttcgtaccttgcatttctctgaattctagtctctcataagcactgctttgctggatgattttcactgctttgtgttaatgactttgagcgatctctcacatgatggggttctttagtacatggtaacagccatgtcatcttacacacctagcattgtgaatgctgtagtgacatcctttataggcaccttacagctcaaaacttttgtttcatttcatgccttacttatca

SEQ ID NO: 122 - DNA, 25 bp, Artificial sequence
  Affy probe set ID: 225626_at
atccctgtattcatggcttgacttt

SEQ ID NO: 123 - DNA, 25 bp, Artificial sequence
  Affy probe set ID: 225626_at
tgactgctctacactgcatgtctga

SEQ ID NO: 124 - DNA, 25 bp, Artificial sequence
  Affy probe set ID: 225626_at
attattttgcaatcagcctggtctc

SEQ ID NO: 125 - DNA, 25 bp, Artificial sequence
  Affy probe set ID: 225626_at
gtctctcccatgaagatgtcgtgtg

SEQ ID NO: 126 - DNA, 25 bp, Artificial sequence
  Affy probe set ID: 225626_at
agaagttcgtaccttgcatttctct

SEQ ID NO: 127 - DNA, 25 bp, Artificial sequence
  Affy probe set ID: 225626_at
gcatttctctgaattctagtctctc

SEQ ID NO: 128 - DNA, 25 bp, Artificial sequence
  Affy probe set ID: 225626_at
ctagtctctcataagcactgctttg

SEQ ID NO: 129 - DNA, 25 bp, Artificial sequence
  Affy probe set ID: 225626_at
gagcgatctctcacatgatggggtt

SEQ ID NO: 130 - DNA, 25 bp, Artificial sequence
  Affy probe set ID: 225626_at
ccatgtcatcttacacacctagcat

SEQ ID NO: 131 - DNA, 25 bp, Artificial sequence
  Affy probe set ID: 225626_at
gtgacatcctttataggcaccttac

SEQ ID NO: 132 - DNA, 25 bp, Artificial sequence
  Affy probe set ID: 225626_at
gtttcatttcatgccttacttatca

SEQ ID NO: 133 - DNA, 276 bp, Artificial sequence
  Target_Sequence, Fragment of GenBank Accession No. NM_004965
catggctctctctgccagaattgtgtgcactctgtaacatctttggttgtggtagtcctgttttcctaataactttgttactgtgctgtgaaagattacagatttgaacatgtagtgtacgtgctattgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggcttttt

SEQ ID NO: 134 - DNA, 25 bp, Artificial sequence
  Affy probe set ID: 200944_s_at
catggctctctctgccagaattgtg

SEQ ID NO: 135 - DNA, 25 bp, Artificial sequence
  Affy probe set ID: 200944_s_at
ctctctgccagaattgtgtgcactc

SEQ ID NO: 136 - DNA, 25 bp, Artificial sequence
  Affy probe set ID: 200944_s_at
gaattgtgtgcactctgtaacatct

SEQ ID NO: 137 - DNA, 25 bp, Artificial sequence
  Affy probe set ID: 200944_s_at
ttgtggtagtcctgttttcctaata

SEQ ID NO: 138 - DNA, 25 bp, Artificial sequence
  Affy probe set ID: 200944_s_at
tagtcctgttttcctaataactttg

SEQ ID NO: 139 - DNA, 25 bp, Artificial sequence
  Affy probe set ID: 200944_s_at
gatttgaacatgtagtgtacgtgct

SEQ ID NO: 140 - DNA, 25 bp, Artificial sequence
  Affy probe set ID: 200944_s_at
agttgtgaactggtgggccgtatgt

SEQ ID NO: 141 - DNA, 25 bp, Artificial sequence
  Affy probe set ID: 200944_s_at
gggccgtatgtaacagctgaccaac

SEQ ID NO: 142 - DNA, 25 bp, Artificial sequence
  Affy probe set ID: 200944_s_at
aacagctgaccaacgtgaagatact

SEQ ID NO: 143 - DNA, 25 bp, Artificial sequence
  Affy probe set ID: 200944_s_at
gatactggtacttgatagcctctta

SEQ ID NO: 144 - DNA, 25 bp, Artificial sequence
  Affy probe set ID: 200944_s_at
aaagaattacaatacatggcttttt

SEQ ID NO: 145 - DNA, 569 bp, Artificial sequence
  Target_Sequence, Fragment of GenBank Accession No. NM_001706
  misc_feature (118)..(118): n is a, c, g, or t
  misc_feature (120)..(120): n is a, c, g, or t
  misc_feature (180)..(180): n is a, c, g, or t
  misc_feature (395)..(395): n is a, c, g, or t
  misc_feature (413)..(413): n is a, c, g, or t
  misc_feature (416)..(417): n is a, c, g, or t
tggggcgcctatgatggagaccctcagcccctagggactccatcttttgaccttgaagtctcgctcaaacattcccctaaaagaacgggggtgagggagaatggaaggcaaaaagagngnaaaaagcaaataaacttcggaatcggacaacttaaagtctcgatatgagcctcggattgnattcgaactcctgggttctagacccagctctgctactaacttgtctgaccttccccatttataaactgttgtgggtgagaggtgggactaggtgaactctgagagccctgcactcggcgcggacgagggatttaggggaaagtgtgctgtattccccgcgagccttccccagcggccccgcctccccgggtgaatccccggcggccagcgcagcncaggcagcgatcctggcngcnnccggggccggcagcttcctggaaagttacttcttgttggagccggcaataggcaaagtgtgttctgtgaaatccgcagagccgagattgactacgttccgggaatgagagggctgtgtcattcccctcattgcctgctgcattgacggcgta

SEQ ID NO: 146 - DNA, 25 bp, Artificial sequence
  Affy probe set ID: 228758_at
tggggcgcctatgatggagaccctc

SEQ ID NO: 147 - DNA, 25 bp, Artificial sequence
  Affy probe set ID: 228758_at
ttgaccttgaagtctcgctcaaaca

SEQ ID NO: 148 - DNA, 25 bp, Artificial sequence
  Affy probe set ID: 228758_at
aagtctcgatatgagcctcggattg

SEQ ID NO: 149 - DNA, 25 bp, Artificial sequence
  Affy probe set ID: 228758_at
ctgaccttccccatttataaactgt

SEQ ID NO: 150 - DNA, 25 bp, Artificial sequence
  Affy probe set ID: 228758_at
taggtgaactctgagagccctgcac

SEQ ID NO: 151 - DNA, 25 bp, Artificial sequence
  Affy probe set ID: 228758_at
tgcactcggcgcggacgagggattt

SEQ ID NO: 152 - DNA, 25 bp, Artificial sequence
  Affy probe set ID: 228758_at
gccggcagcttcctggaaagttact

SEQ ID NO: 153 - DNA, 25 bp, Artificial sequence
  Affy probe set ID: 228758_at
gaaagttacttcttgttggagccgg

SEQ ID NO: 154 - DNA, 25 bp, Artificial sequence
  Affy probe set ID: 228758_at
cagagccgagattgactacgttccg

SEQ ID NO: 155 - DNA, 25 bp, Artificial sequence
  Affy probe set ID: 228758_at
tgagagggctgtgtcattcccctca

SEQ ID NO: 156 - DNA, 25 bp, Artificial sequence
  Affy probe set ID: 228758_at
cattgcctgctgcattgacggcgta

SEQ ID NO: 157 - DNA, 458 bp, Artificial sequence
  Target_Sequence, Fragment of GenBank Accession No. NM_020747
  misc_feature (327)..(327): n is a, c, g, or t
  misc_feature (390)..(391): n is a, c, g, or t
  misc_feature (419)..(419): n is a, c, g, or t
gtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgngtaccagagacatctgtgattgttctattacttgaatagttctacagtctttttttttttttnnaatgtttacaattatccagttttagaanagagagactttaacgccattgcctggttacttgttttat

SEQ ID NO: 158 - DNA, 25 bp, Artificial sequence
  Affy probe set ID: 229817_at
gtatcagtgtgcctgaaccttgcat

SEQ ID NO: 159 - DNA, 25 bp, Artificial sequence
  Affy probe set ID: 229817_at
tgaaccttgcatatccttcacatat

SEQ ID NO: 160 - DNA, 25 bp, Artificial sequence
  Affy probe set ID: 229817_at
ttcccataagcccctcagaaaggct

SEQ ID NO: 161 - DNA, 25 bp, Artificial sequence
  Affy probe set ID: 229817_at
ttagatgtctatttggtggctcctg

SEQ ID NO: 162 - DNA, 25 bp, Artificial sequence
  Affy probe set ID: 229817_at
gtggctcctgttaaagacgcaccag

SEQ ID NO: 163 - DNA, 25 bp, Artificial sequence
  Affy probe set ID: 229817_at
gacgcaccagtgtaaaatgttcctg

SEQ ID NO: 164 - DNA, 25 bp, Artificial sequence
  Affy probe set ID: 229817_at
tcctgtagtcactgtttgtacttgt

SEQ ID NO: 165 - DNA, 25 bp, Artificial sequence
  Affy probe set ID: 229817_at
gcatggggttgccagtaccacaaaa

SEQ ID NO: 166 - DNA, 25 bp, Artificial sequence
  Affy probe set ID: 229817_at
gagacatctgtgattgttctattac

SEQ ID NO: 167 - DNA, 25 bp, Artificial sequence
  Affy probe set ID: 229817_at
agagagactttaacgccattgcctg

SEQ ID NO: 168 - DNA, 25 bp, Artificial sequence
  Affy probe set ID: 229817_at
gccattgcctggttacttgttttat

SEQ ID NO: 169 - DNA, 422 bp, Artificial sequence
  Target_Sequence, Fragment of GenBank Accession No. NM_001001695
  misc_feature (28)..(28): n is a, c, g, or t
  misc_feature (34)..(34): n is a, c, g, or t
  misc_feature (279)..(279): n is a, c, g, or t
tttccaaaatctgcacatctccaacttntctttnagctagaggtggccctgtgattgatgagtgaccagccatgtgtggagaaaagcaatgtgaacaacttctgacttcgctgttaaagaaaattggtctgtcccccatttccttgcattcccattcttactggctgaaattcaaagctgataaatggagctagagcagatagctgggaaaatgagttgagggtcttacattaagacttgccagcaagaagaagaatttttccagggttcctgacaccnccaaattgttcgatcagctctgaactctatactgagattctttaagtatgagagacatgaactttgactggcttaagtgagctattgaggtctctttgctattgtgacctaactcaggggtcagcaaataacactctgtgcgc

SEQ ID NO: 170 - DNA, 25 bp, Artificial sequence
  Affy probe set ID: 231455_at
tttccaaaatctgcacatctccaac

SEQ ID NO: 171 - DNA, 25 bp, Artificial sequence
  Affy probe set ID: 231455_at
gccctgtgattgatgagtgaccagc

SEQ ID NO: 172 - DNA, 25 bp, Artificial sequence
  Affy probe set ID: 231455_at
gatgagtgaccagccatgtgtggag

SEQ ID NO: 173 - DNA, 25 bp, Artificial sequence
  Affy probe set ID: 231455_at
acaacttctgacttcgctgttaaag

SEQ ID NO: 174 - DNA, 25 bp, Artificial sequence
  Affy probe set ID: 231455_at
ttcccattcttactggctgaaattc

SEQ ID NO: 175 - DNA, 25 bp, Artificial sequence
  Affy probe set ID: 231455_at
tcttacattaagacttgccagcaag

SEQ ID NO: 176 - DNA, 25 bp, Artificial sequence
  Affy probe set ID: 231455_at
gttcgatcagctctgaactctatac

SEQ ID NO: 177 - DNA, 25 bp, Artificial sequence
  Affy probe set ID: 231455_at
gagacatgaactttgactggcttaa

SEQ ID NO: 178 - DNA, 25 bp, Artificial sequence
  Affy probe set ID: 231455_at
gtgagctattgaggtctctttgcta

SEQ ID NO: 179 - DNA, 25 bp, Artificial sequence
  Affy probe set ID: 231455_at
tctttgctattgtgacctaactcag

SEQ ID NO: 180 - DNA, 25 bp, Artificial sequence
  Affy probe set ID: 231455_at
ggtcagcaaataacactctgtgcgc

SEQ ID NO: 181 - DNA, 553 bp, Artificial sequence
  Target_Sequence, Fragment of GenBank Accession No. NM_015055
  misc_feature (120)..(121): n is a, c, g, or t
  misc_feature (123)..(123): n is a, c, g, or t
  misc_feature (246)..(246): n is a, c, g, or t
  misc_feature (249)..(249): n is a, c, g, or t
tctgtggtgacaacggaggaaatatccaacagaaatacgtctaacagggaaattgggatcatagtttatatgcatctgatttgaaaggagtattgaggaaggttttcatatatgatctanntnttggattaaaaagaacatttatgaaatcaagccttctaacactagttataattgagaagcaacagtaactccgtggacagcaatcaagcttaaaattgtaaataaatatggggataattcagntgntgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaag

SEQ ID NO: 182 - DNA, 25 bp, Artificial sequence
  Affy probe set ID: 209306_s_at
tctgtggtgacaacggaggaaatat

SEQ ID NO: 183 - DNA, 25 bp, Artificial sequence
  Affy probe set ID: 209306_s_at
atagtttatatgcatctgatttgaa

SEQ ID NO: 184 - DNA, 25 bp, Artificial sequence
  Affy probe set ID: 209306_s_at
gaaatcaagccttctaacactagtt

SEQ ID NO: 185 - DNA, 25 bp, Artificial sequence
  Affy probe set ID: 209306_s_at
gaagcaacagtaactccgtggacag

SEQ ID NO: 186 - DNA, 25 bp, Artificial sequence
  Affy probe set ID: 209306_s_at
agtaactccgtggacagcaatcaag

SEQ ID NO: 187 - DNA, 25 bp, Artificial sequence
  Affy probe set ID: 209306_s_at
acctcaggtgttcttatgctagtgc

SEQ ID NO: 188 - DNA, 25 bp, Artificial sequence
  Affy probe set ID: 209306_s_at
gctagtgcttgctgagtgcatacta

SEQ ID NO: 189 - DNA, 25 bp, Artificial sequence
  Affy probe set ID: 209306_s_at
gagagtggtattagagattcagtgt

SEQ ID NO: 190 - DNA, 25 bp, Artificial sequence
  Affy probe set ID: 209306_s_at
tataatcccataaattatcaccttt

SEQ ID NO: 191 - DNA, 25 bp, Artificial sequence
  Affy probe set ID: 209306_s_at
aattatcaccttttatgactggaaa

SEQ ID NO: 192 - DNA, 25 bp, Artificial sequence
  Affy probe set ID: 209306_s_at
atggtctgtaggtatttgtcttaag

SEQ ID NO: 193 - DNA, 460 bp, Artificial sequence
  Target_Sequence, Fragment of GenBank Accession No. NM_005607
  misc_feature (87)..(87): n is a, c, g, or t
  misc_feature (211)..(211): n is a, c, g, or t
tgcaatatgctaatcccactttacaaagaatataaaagctatattttgaagacttgagttatttcagaaaaaactacagcccttttngtcttacctgccttttactttcgtgtggatatgtgaagcattgggtcgggaactagctgtagaacacaactaaaaactcatgtcttttttcacagaataatgtgccagttttttgtagcaatgntatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattt

SEQ ID NO: 194 - DNA, 25 bp, Artificial sequence
  Affy probe set ID: 208820_at
tgcaatatgctaatcccactttaca

SEQ ID NO: 195 - DNA, 25 bp, Artificial sequence
  Affy probe set ID: 208820_at
acctgccttttactttcgtgtggat

SEQ ID NO: 196 - DNA, 25 bp, Artificial sequence
  Affy probe set ID: 208820_at
tatgtgaagcattgggtcgggaact

SEQ ID NO: 197 - DNA, 25 bp, Artificial sequence
  Affy probe set ID: 208820_at
gggtcgggaactagctgtagaacac

SEQ ID NO: 198 - DNA, 25 bp, Artificial sequence
  Affy probe set ID: 208820_at
gaataatgtgccagttttttgtagc

SEQ ID NO: 199 - DNA, 25 bp, Artificial sequence
  Affy probe set ID: 208820_at
aaatgctttgtaccagagcacctcc

SEQ ID NO: 200 - DNA, 25 bp, Artificial sequence
  Affy probe set ID: 208820_at
cagagcacctccaaactgcattgag

SEQ ID NO: 201 - DNA, 25 bp, Artificial sequence
  Affy probe set ID: 208820_at
aaagccatgttgactattttacagc

SEQ ID NO: 202 - DNA, 25 bp, Artificial sequence
  Affy probe set ID: 208820_at
acagccactggagttaactaaccct

SEQ ID NO: 203 - DNA, 25 bp, Artificial sequence
  Affy probe set ID: 208820_at
tttcttttgatgtccagttacacca

SEQ ID NO: 204 - DNA, 25 bp, Artificial sequence
  Affy probe set ID: 208820_at
gttacaccatccattctgttaattt

SEQ ID NO: 205 - DNA, 558 bp, Artificial sequence
  Target_Sequence, Fragment of GenBank Accession No. XM_027236
  misc_feature (38)..(38): n is a, c, g, or t
  misc_feature (55)..(55): n is a, c, g, or t
  misc_feature (57)..(57): n is a, c, g, or t
  misc_feature (59)..(59): n is a, c, g, or t
  misc_feature (62)..(62): n is a, c, g, or t
  misc_feature (66)..(66): n is a, c, g, or t
  misc_feature (69)..(69): n is a, c, g, or t
  misc_feature (78)..(78): n is a, c, g, or t
  misc_feature (84)..(84): n is a, c, g, or t
  misc_feature (90)..(90): n is a, c, g, or t
  misc_feature (98)..(98): n is a, c, g, or t
  misc_feature (104)..(104): n is a, c, g, or t
  misc_feature (115)..(115): n is a, c, g, or t
  misc_feature (120)..(120): n is a, c, g, or t
  misc_feature (130)..(130): n is a, c, g, or t
  misc_feature (140)..(140): n is a, c, g, or t
  misc_feature (151)..(151): n is a, c, g, or t
tttttatcatcaatcctcaaatagtgattatttcattntgttcccaatcttcatngntnaantagntgntgcaactgnacattncttgtnagctaaanttttgncacatgtctantaacngatttccttnaggataaacntccaagaagangacttgcttggctatttttaagaattttgatacatgttgccaaccaccctccagaaagtttgtaccaaaacgctctcctatttggatcctagagagtaccctgtttcctgcaccctaacactaggtatcatcacttatcaaatctttcccaatttggtagctgggataatagtatgtcaatgttattttaactttctttgattcttcgcgaataacattttcatatgcttattgaccatttgtacttctttctttgtgaattttctatttatttgatattggtatgtttattatcaatttgtaattttattaagaatattatttttgtcaagaaatgctgcaaatatgctttccaagtgctttgctttcaaattttgtttatggtgctttttgacatacataaattc

SEQ ID NO: 206 - DNA, 25 bp, Artificial sequence
  Affy probe set ID: 213172_at
tttttatcatcaatcctcaaatagt

SEQ ID NO: 207 - DNA, 25 bp, Artificial sequence
  Affy probe set ID: 213172_at
aaaacgctctcctatttggatccta

SEQ ID NO: 208 - DNA, 25 bp, Artificial sequence
  Affy probe set ID: 213172_at
tggatcctagagagtaccctgtttc

SEQ ID NO: 209 - DNA, 25 bp, Artificial sequence
  Affy probe set ID: 213172_at
tttcctgcaccctaacactaggtat

SEQ ID NO: 210 - DNA, 25 bp, Artificial sequence
  Affy probe set ID: 213172_at
aacactaggtatcatcacttatcaa

SEQ ID NO: 211 - DNA, 25 bp, Artificial sequence
  Affy probe set ID: 213172_at
atcacttatcaaatctttcccaatt

SEQ ID NO: 212 - DNA, 25 bp, Artificial sequence
  Affy probe set ID: 213172_at
aaatctttcccaatttggtagctgg

SEQ ID NO: 213 - DNA, 25 bp, Artificial sequence
  Affy probe set ID: 213172_at
tttaactttctttgattcttcgcga

SEQ ID NO: 214 - DNA, 25 bp, Artificial sequence
  Affy probe set ID: 213172_at
attcttcgcgaataacattttcata

SEQ ID NO: 215 - DNA, 25 bp, Artificial sequence
  Affy probe set ID: 213172_at
aatatgctttccaagtgctttgctt

SEQ ID NO: 216 - DNA, 25 bp, Artificial sequence
  Affy probe set ID: 213172_at
ggtgctttttgacatacataaattc

SEQ ID NO: 217 - DNA, 310 bp, Artificial sequence
  Target_Sequence, Fragment of GenBank Accession No. BQ213652
caaagctcacagaagcacgctggtagatttctcctctttggtggtttcccatgaccagccaagggaaatacccaacaatcattctcagtgtgcacagatttaccttcagcttttttggttatattgtcattattattttctttgtccagtgggagagttaaggggcctgctatggactgaactctgtccccctcaaattcatatgttgaagccccaaccttcaacatgactatatttgaaaacagtccctttatggaggtaaagttaaatgagatcataagagtggggcccttgttcgatagaactggtg

SEQ ID NO: 218 - DNA, 25 bp, Artificial sequence
  Affy probe set ID: 1569034_a_at
caaagctcacagaagcacgctggta

SEQ ID NO: 219 - DNA, 25 bp, Artificial sequence
  Affy probe set ID: 1569034_a_at
aagcacgctggtagatttctcctct

SEQ ID NO: 220 - DNA, 25 bp, Artificial sequence
  Affy probe set ID: 1569034_a_at
tcctctttggtggtttcccatgacc

SEQ ID NO: 221 - DNA, 25 bp, Artificial sequence
  Affy probe set ID: 1569034_a_at
tggtttcccatgaccagccaaggga

SEQ ID NO: 222 - DNA, 25 bp, Artificial sequence
  Affy probe set ID: 1569034_a_at
gggaaatacccaacaatcattctca

SEQ ID NO: 223 - DNA, 25 bp, Artificial sequence
  Affy probe set ID: 1569034_a_at
aacaatcattctcagtgtgcacaga

SEQ ID NO: 224 - DNA, 25 bp, Artificial sequence
  Affy probe set ID: 1569034_a_at
cagtgtgcacagatttaccttcagc

SEQ ID NO: 225 - DNA, 25 bp, Artificial sequence
  Affy probe set ID: 1569034_a_at
tattattttctttgtccagtgggag

SEQ ID NO: 226 - DNA, 25 bp, Artificial sequence
  Affy probe set ID: 1569034_a_at
gccccaaccttcaacatgactatat

SEQ ID NO: 227 - DNA, 25 bp, Artificial sequence
  Affy probe set ID: 1569034_a_at
gactatatttgaaaacagtcccttt

SEQ ID NO: 228 - DNA, 25 bp, Artificial sequence
  Affy probe set ID: 1569034_a_at
gggcccttgttcgatagaactggtg

SEQ ID NO: 229 - DNA, 469 bp, Artificial sequence
  Target_Sequence, Fragment of GenBank Accession No. NM_005574
acagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaagggaaaactgcatggagacgcatttcggttgagaatggaaaccacaacttttaaccaaacaattatttaaagcaatgctgatgaatcactgtttttagacaccttcattttgaggggaggagttccacagattgtttcta

SEQ ID NO: 230 - DNA, 25 bp, Artificial sequence
  Affy probe set ID: 204249_s_at
acagaaggaccagcccttgagggag

SEQ ID NO: 231 - DNA, 25 bp, Artificial sequence
  Affy probe set ID: 204249_s_at
cttgagggagaacttatggccacag

SEQ ID NO: 232 - DNA, 25 bp, Artificial sequence
  Affy probe set ID: 204249_s_at
ccacagcccatccatagtaactgac

SEQ ID NO: 233 - DNA, 25 bp, Artificial sequence
  Affy probe set ID: 204249_s_at
gaacatttaggggcaagcaggcgct

SEQ ID NO: 234 - DNA, 25 bp, Artificial sequence
  Affy probe set ID: 204249_s_at
caggcgctgtgctatcatgatggaa

SEQ ID NO: 235 - DNA, 25 bp, Artificial sequence
  Affy probe set ID: 204249_s_at
gacttgttgtgactttgacgcttgc

SEQ ID NO: 236 - DNA, 25 bp, Artificial sequence
  Affy probe set ID: 204249_s_at
tgacgcttgcgaactagagatgtgc

SEQ ID NO: 237 - DNA, 25 bp, Artificial sequence
  Affy probe set ID: 204249_s_at
gaaaggagagtggccattctttttt

SEQ ID NO: 238 - DNA, 25 bp, Artificial sequence
  Affy probe set ID: 204249_s_at
aactgcatggagacgcatttcggtt

SEQ ID NO: 239 - DNA, 25 bp, Artificial sequence
  Affy probe set ID: 204249_s_at
gaatcactgtttttagacaccttca

SEQ ID NO: 240 - DNA, 25 bp, Artificial sequence
  Affy probe set ID: 204249_s_at
ggaggagttccacagattgtttcta

SEQ ID NO: 241 - DNA, 440 bp, Artificial sequence
  Target_Sequence, Fragment of GenBank Accession No. NM_014667
  misc_feature (120)..(120): n is a, c, g, or t
  misc_feature (273)..(273): n is a, c, g, or t
  misc_feature (296)..(296): n is a, c, g, or t
actgcatctgcattcatagccacgagtttgttattgctacaggctactgagcgtcgtaacaggaaaaccacccacagctgaccggctcggtggaggacactcctgggacaggtctctttngtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccntccctgctctaagaaggggctcngtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtac

SEQ ID NO: 242 - DNA, 25 bp, Artificial sequence
  Affy probe set ID: 212399_s_at
actgcatctgcattcatagccacga

SEQ ID NO: 243 - DNA, 25 bp, Artificial sequence
  Affy probe set ID: 212399_s_at
gccacgagtttgttattgctacagg

SEQ ID NO: 244 - DNA, 25 bp, Artificial sequence
  Affy probe set ID: 212399_s_at
gctacaggctactgagcgtcgtaac

SEQ ID NO: 245 - DNA, 25 bp, Artificial sequence
  Affy probe set ID: 212399_s_at
gtcgtaacaggaaaaccacccacag

SEQ ID NO: 246 - DNA, 25 bp, Artificial sequence
  Affy probe set ID: 204249_s_at
aggacactcctgggacaggtctctt

SEQ ID NO: 247 - DNA, 25 bp, Artificial sequence
  Affy probe set ID: 204249_s_at
gtgaacaagggcgtcactctgggag

SEQ ID NO: 248 - DNA, 25 bp, Artificial sequence
  Affy probe set ID: 212399_s_at
ccctggtgcactgacctatctggga

SEQ ID NO: 249 - DNA, 25 bp, Artificial sequence
  Affy probe set ID: 212399_s_at
tgggataggcagtaccctggagggg

SEQ ID NO: 250 - DNA, 25 bp, Artificial sequence
  Affy probe set ID: 212399_s_at
tctgaccttctcttcatgtgtgtaa

SEQ ID NO: 251 - DNA, 25 bp, Artificial sequence
  Affy probe set ID: 212399_s_at
atataccattctctgtggcctgttt

SEQ ID NO: 252 - DNA, 25 bp, Artificial sequence
  Affy probe set ID: 212399_s_at
tttggcaggccatctttttttgtac

SEQ ID NO: 253 - DNA, 562 bp, Artificial sequence
  Target_Sequence, Fragment of GenBank Accession No. NM_002221
aggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggacccccccgcctgccgagaggctctcttcctgttctgcacccctctccccatgggaccttggagaaaactgaactgttacaaacccctgcacagtgcctgtcaaacaga

SEQ ID NO: 254 - DNA, 25 bp, Artificial sequence
  Affy probe set ID: 203723_at
aggacaaactctgtgtacctgtgcc

SEQ ID NO: 255 - DNA, 25 bp, Artificial sequence
  Affy probe set ID: 203723_at
ccaggtgaatgggcgcagggtcctc

SEQ ID NO: 256 - DNA, 25 bp, Artificial sequence
  Affy probe set ID: 203723_at
tcctggcattcagcactgcttagca

SEQ ID NO: 257 - DNA, 25 bp, Artificial sequence
  Affy probe set ID: 203723_at
gcactgcttagcattctcggaaggt

SEQ ID NO: 258 - DNA, 25 bp, Artificial sequence
  Affy probe set ID: 203723_at
ccaggcttgcctttagtgtcatgta

SEQ ID NO: 259 - DNA, 25 bp, Artificial sequence
  Affy probe set ID: 203723_at
cgaaaggctggactcttgtttctcc

SEQ ID NO: 260 - DNA, 25 bp, Artificial sequence
  Affy probe set ID: 203723_at
gtagaaagagcccagaagcagccct

SEQ ID NO: 261 - DNA, 25 bp, Artificial sequence
  Affy probe set ID: 203723_at
ctggccctgtaagatggactctttc

SEQ ID NO: 262 - DNA, 25 bp, Artificial sequence
  Affy probe set ID: 203723_at
gactctttcatccttcagttgtatt

SEQ ID NO: 263 - DNA, 25 bp, Artificial sequence
  Affy probe set ID: 203723_at
tgaactgttacaaacccctgcacag

SEQ ID NO: 264 - DNA, 25 bp, Artificial sequence
  Affy probe set ID: 203723_at
ccctgcacagtgcctgtcaaacaga

SEQ ID NO: 265 - DNA, 540 bp, Artificial sequence
  Target_Sequence, Fragment of GenBank Accession No. NM_000902
gttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcaga

SEQ ID NO: 266 - DNA, 25 bp, Artificial sequence
  Affy probe set ID: 203434_s_at
gttattcattctgtgatcatttatt

SEQ ID NO: 267 - DNA, 25 bp, Artificial sequence
  Affy probe set ID: 203434_s_at
tttgttgtacctgctttgactgatg

SEQ ID NO: 268 - DNA, 25 bp, Artificial sequence
  Affy probe set ID: 203434_s_at
gctttgactgatgctgagattcttc

SEQ ID NO: 269 - DNA, 25 bp, Artificial sequence
  Affy probe set ID: 203434_s_at
ggcttcctgcaattttctaagcaat

SEQ ID NO: 270 - DNA, 25 bp, Artificial sequence
  Affy probe set ID: 203434_s_at
agcaatttcttgctctatctctcaa

SEQ ID NO: 271 - DNA, 25 bp, Artificial sequence
  Affy probe set ID: 203434_s_at
gctctatctctcaaaacttggtatt

SEQ ID NO: 272 - DNA, 25 bp, Artificial sequence
  Affy probe set ID: 203434_s_at
tgtggttttcaaattggactttcaa

SEQ ID NO: 273 - DNA, 25 bp, Artificial sequence
  Affy probe set ID: 203434_s_at
aaatctgtccctgagagtgtctctg

SEQ ID NO: 274 - DNA, 25 bp, Artificial sequence
  Affy probe set ID: 203434_s_at
agggcaaatctgcacctatgtagct

SEQ ID NO: 275 - DNA, 25 bp, Artificial sequence
  Affy probe set ID: 203434_s_at
tctgcacctatgtagctctgcatct

SEQ ID NO: 276 - DNA, 25 bp, Artificial sequence
  Affy probe set ID: 203434_s_at
ctgtcttttcaggtttgtcatcaga

SEQ ID NO: 277 - DNA, 443 bp, Artificial sequence
  Target_Sequence, Fragment of GenBank Accession No. NM_012446
aggaatctcagtcacaccaaaccaaccttttcatttcctgctctctcccctcttttgtgaagaaagcgggtccagatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtatatgtctgcaatcatggatagg

SEQ ID NO: 278 - DNA, 25 bp, Artificial sequence
  Affy probe set ID: 203787_at
aggaatctcagtcacaccaaaccaa

SEQ ID NO: 279 - DNA, 25 bp, Artificial sequence
  Affy probe set ID: 203787_at
aagcgggtccagatgtgattcaaac

SEQ ID NO: 280 - DNA, 25 bp, Artificial sequence
  Affy probe set ID: 203787_at
gattcaaacaactgtacggagtggc

SEQ ID NO: 281 - DNA, 25 bp, Artificial sequence
  Affy probe set ID: 203787_at
ggagtggcatattagaattgcccta

SEQ ID NO: 282 - DNA, 25 bp, Artificial sequence
  Affy probe set ID: 203787_at
acacatacatacattgacccacagg

SEQ ID NO: 283 - DNA, 25 bp, Artificial sequence
  Affy probe set ID: 203787_at
acattgacccacaggacattgtaaa

SEQ ID NO: 284 - DNA, 25 bp, Artificial sequence
  Affy probe set ID: 203787_at
taagtagggacttttattccatcct

SEQ ID NO: 285 - DNA, 25 bp, Artificial sequence
  Affy probe set ID: 203787_at
taattattacaagttgctcctgccc

SEQ ID NO: 286 - DNA, 25 bp, Artificial sequence
  Affy probe set ID: 203787_at
cctccctgaactattttgtgctgtg

SEQ ID NO: 287 - DNA, 25 bp, Artificial sequence
  Affy probe set ID: 203787_at
ggtgaactcagatgttatggttttg

SEQ ID NO: 288 - DNA, 25 bp, Artificial sequence
  Affy probe set ID: 203787_at
gtatatgtctgcaatcatggatagg

SEQ ID NO: 289 - DNA, 550 bp, Artificial sequence
  Target_Sequence, Fragment of GenBank Accession No. NM_024613
gttctagccatgaatttgcctgagaaacttgtaacctatgtgcctcaatatattccatagaaagtaggtccccctgccttctcccactcctcacactcttctacagggataggcttttgcaaatatatcagataaattttttgtttcttgtttatttttaggttattttcttggaaggttgggaaaagatgtttgttttaacaggtcatgtactacgttgttgttttcatttctgttataagtaaaactaaaagcacagaatggtgggaaaggggctataatgtggttcattaataatgttagcagcttttttctaaccatcctgtctaatggttaagacaccagtaacaaaaacacatgatttggaaatactttggctttttcatatacctagtggtgccttatcataatagcactgttacatgaaataagcccctaccttcttactttctggtttgttgaaaaaatacactggtgctctttgaagtgataaaatgagtgtttatgaatgggtgtaattaggaaatacttctcatctgacagctacaaa

SEQ ID NO: 290 - DNA, 25 bp, Artificial sequence
  Affy probe set ID: 222699_s_at
gttctagccatgaatttgcctgaga

SEQ ID NO: 291 - DNA, 25 bp, Artificial sequence
  Affy probe set ID: 222699_s_at
gcctgagaaacttgtaacctatgtg

SEQ ID NO: 292 - DNA, 25 bp, Artificial sequence
  Affy probe set ID: 222699_s_at
aacctatgtgcctcaatatattcca

SEQ ID NO: 293 - DNA, 25 bp, Artificial sequence
  Affy probe set ID: 222699_s_at
ttccatagaaagtaggtccccctgc

SEQ ID NO: 294 - DNA, 25 bp, Artificial sequence
  Affy probe set ID: 222699_s_at
tcctcacactcttctacagggatag

SEQ ID NO: 295 - DNA, 25 bp, Artificial sequence
  Affy probe set ID: 222699_s_at
gtcatgtactacgttgttgttttca

SEQ ID NO: 296 - DNA, 25 bp, Artificial sequence
  Affy probe set ID: 222699_s_at
agcagcttttttctaaccatcctgt

SEQ ID NO: 297 - DNA, 25 bp, Artificial sequence
  Affy probe set ID: 222699_s_at
tttggctttttcatatacctagtgg

SEQ ID NO: 298 - DNA, 25 bp, Artificial sequence
  Affy probe set ID: 222699_s_at
atacctagtggtgccttatcataat

SEQ ID NO: 299 - DNA, 25 bp, Artificial sequence
  Affy probe set ID: 222699_s_at
acatgaaataagcccctaccttctt

SEQ ID NO: 300 - DNA, 25 bp, Artificial sequence
  Affy probe set ID: 222699_s_at
atacttctcatctgacagctacaaa

SEQ ID NO: 301 - DNA, 360 bp, Artificial sequence
  Target_Sequence, Fragment of GenBank Accession No. AV705976
gaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatct

SEQ ID NO: 302 - DNA, 25 bp, Artificial sequence
  Affy probe set ID: 204681_s_at
gaaatcttgccttttaatgtatcat

SEQ ID NO: 303 - DNA, 25 bp, Artificial sequence
  Affy probe set ID: 204681_s_at
atgtatcattaattagggctgctgt

SEQ ID NO: 304 - DNA, 25 bp, Artificial sequence
  Affy probe set ID: 204681_s_at
ggctgctgtgatattgtcagcttgc

SEQ ID NO: 305 - DNA, 25 bp, Artificial sequence
  Affy probe set ID: 204681_s_at
agaagatagagaacccgccatcagg

SEQ ID NO: 306 - DNA, 25 bp, Artificial sequence
  Affy probe set ID: 204681_s_at
gagaacccgccatcagggtgtctac

SEQ ID NO: 307 - DNA, 25 bp, Artificial sequence
  Affy probe set ID: 204681_s_at
ggtgtctacctaacttctcagggac

SEQ ID NO: 308 - DNA, 25 bp, Artificial sequence
  Affy probe set ID: 204681_s_at
tacacttggtagttttccaccattt

SEQ ID NO: 309 - DNA, 25 bp, Artificial sequence
  Affy probe set ID: 204681_s_at
tgttgagttaccagaattgccatta

SEQ ID NO: 310 - DNA, 25 bp, Artificial sequence
  Affy probe set ID: 204681_s_at
gccattaacagtgttttctttccca

SEQ ID NO: 311 - DNA, 25 bp, Artificial sequence
  Affy probe set ID: 204681_s_at
atatgtatatgactgtgctgtgtat

SEQ ID NO: 312 - DNA, 25 bp, Artificial sequence
  Affy probe set ID: 204681_s_at
tatataagtaacccttaccttatct

SEQ ID NO: 313 - DNA, 410 bp, Artificial sequence
  Target_Sequence, Fragment of GenBank Accession No. NM_012108
attacctatattctcctgatactgattaccaagtcattcacctgaacaccagaattagaattaaacattgtaccatacaatttcattatcttatcagaatgaaaccaattcacagggaaactagagactacggctgtggtggtaacctgcagatatacacattcccatgcactgacataagttgaaaacacatagtactttctagatggaatttttttctttaggcctcaatgaaatacatttcccctatataattccaacagcagtttctctagttctaaattttaccaattcccaaaaaacctaagttttgctgaaatctgatttgaccaatttatcaaatatgtcattttaattacctagctggaagttagagacatgaaatgtactagaggagcccttttccaatg

SEQ ID NO: 314 - DNA, 25 bp, Artificial sequence
  Affy probe set ID: 220059_at
attacctatattctcctgatactga

SEQ ID NO: 315 - DNA, 25 bp, Artificial sequence
  Affy probe set ID: 220059_at
gattaccaagtcattcacctgaaca

SEQ ID NO: 316 - DNA, 25 bp, Artificial sequence
  Affy probe set ID: 220059_at
aactagagactacggctgtggtggt

SEQ ID NO: 317 - DNA, 25 bp, Artificial sequence
  Affy probe set ID: 220059_at
acggctgtggtggtaacctgcagat

SEQ ID NO: 318 - DNA, 25 bp, Artificial sequence
  Affy probe set ID: 220059_at
aacctgcagatatacacattcccat

SEQ ID NO: 319 - DNA, 25 bp, Artificial sequence
  Affy probe set ID: 220059_at
acacattcccatgcactgacataag

SEQ ID NO: 320 - DNA, 25 bp, Artificial sequence
  Affy probe set ID: 220059_at
gaatttttttctttaggcctcaatg

SEQ ID NO: 321 - DNA, 25 bp, Artificial sequence
  Affy probe set ID: 220059_at
acatttcccctatataattccaaca

SEQ ID NO: 322 - DNA, 25 bp, Artificial sequence
  Affy probe set ID: 220059_at
attccaacagcagtttctctagttc

SEQ ID NO: 323 - DNA, 25 bp, Artificial sequence
  Affy probe set ID: 220059_at
tgtcattttaattacctagctggaa

SEQ ID NO: 324 - DNA, 25 bp, Artificial sequence
  Affy probe set ID: 220059_at
gtactagaggagcccttttccaatg

SEQ ID NO: 325 - DNA, 540 bp, Artificial sequence
  Target_Sequence, Fragment of GenBank Accession No. NM_014397
  misc_feature (500)..(500): n is a, c, g, or t
agacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttngtatcttttcaatcaagctgtgtgcttaatttactctgtt

SEQ ID NO: 326 - DNA, 25 bp, Artificial sequence
  Affy probe set ID: 223158_s_at
agacctgacatcggatacgtgcacc

SEQ ID NO: 327 - DNA, 25 bp, Artificial sequence
  Affy probe set ID: 223158_s_at
gtccagcacctgagcgtggatgcac

SEQ ID NO: 328 - DNA, 25 bp, Artificial sequence
  Affy probe set ID: 223158_s_at
gtggatgcaccgtgccttatcaaag

SEQ ID NO: 329 - DNA, 25 bp, Artificial sequence
  Affy probe set ID: 223158_s_at
gtggccacctggtagcctagaacag

SEQ ID NO: 330 - DNA, 25 bp, Artificial sequence
  Affy probe set ID: 223158_s_at
tggtcagattccaaagtcctttctt

SEQ ID NO: 331 - DNA, 25 bp, Artificial sequence
  Affy probe set ID: 223158_s_at
gttgtggacaatctcagctgggtca

SEQ ID NO: 332 - DNA, 25 bp, Artificial sequence
  Affy probe set ID: 223158_s_at
aagggcaggtggttcagcgagccac

SEQ ID NO: 333 - DNA, 25 bp, Artificial sequence
  Affy probe set ID: 223158_s_at
cagccccctgtatctggattgtaat

SEQ ID NO: 334 - DNA, 25 bp, Artificial sequence
  Affy probe set ID: 223158_s_at
taattcctccagtgacctgtcaagg

SEQ ID NO: 335 - DNA, 25 bp, Artificial sequence
  Affy probe set ID: 223158_s_at
gagacttgcaggagaccgtgtgatt

SEQ ID NO: 336 - DNA, 25 bp, Artificial sequence
  Affy probe set ID: 223158_s_at
agctgtgtgcttaatttactctgtt

SEQ ID NO: 337 - DNA, 449 bp, Artificial sequence
  Target_Sequence, Fragment of GenBank Accession No. NM_018981
  misc_feature (208)..(208): n is a, c, g, or t
aactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcntagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaag

SEQ ID NO: 338 - DNA, 25 bp, Artificial sequence
  Affy probe set ID: 225174_at
aactgggcattgtagagtatcctaa

SEQ ID NO: 339 - DNA, 25 bp, Artificial sequence
  Affy probe set ID: 225174_at
gctttcatagaaattttcccactga

SEQ ID NO: 340 - DNA, 25 bp, Artificial sequence
  Affy probe set ID: 225174_at
cccactgatagttgatttttgaggc

SEQ ID NO: 341 - DNA, 25 bp, Artificial sequence
  Affy probe set ID: 225174_at
ttacatatttgccttctgaactttg

SEQ ID NO: 342 - DNA, 25 bp, Artificial sequence
  Affy probe set ID: 225174_at
ctttgttttgacctgtatcctttat

SEQ ID NO: 343 - DNA, 25 bp, Artificial sequence
  Affy probe set ID: 225174_at
tttcactcctgtccagtctatttat

SEQ ID NO: 344 - DNA, 25 bp, Artificial sequence
  Affy probe set ID: 225174_at
aggttgttttactgtagcttataat

SEQ ID NO: 345 - DNA, 25 bp, Artificial sequence
  Affy probe set ID: 225174_at
gatactgtagttattccagttacta

SEQ ID NO: 346 - DNA, 25 bp, Artificial sequence
  Affy probe set ID: 225174_at
tgtcagagggctgcctttttcagat

SEQ ID NO: 347 - DNA, 25 bp, Artificial sequence
  Affy probe set ID: 225174_at
agggatcttctagtttctgtgttgt

SEQ ID NO: 348 - DNA, 25 bp, Artificial sequence
  Affy probe set ID: 225174_at
gtttctgtgttgtttagactcaaag

SEQ ID NO: 349 - DNA, 422 bp, Artificial sequence
  Target_Sequence, Fragment of GenBank Accession No. NM_001379
  misc_feature (61)..(61): n is a, c, g, or t
gtggctagggacatttcctggggacactctcccctaaccccccagaaggacttcacaaaancctgtggataatggaagggatgttacggtacaaacgtatatttatgtgtgtgtgtgtgtatgtgtgtgcgcgcgcgcgtgtgcacataggcgtgatgtctgtgaccctcctctcctcgtcacatttcccccagaatgaatgctgtcctgtctgctcatgtttgtgttgaagctgccaaagtcggggagctctggtcctgcccagacccctttggaattgctggcccatcctcccactggagagctggggtgcagctcaccttggggaaggaaacctcatgcctcagagtaatttcttgtgaatgcaaagcctgggggagcgggtctttggggggcaaggagccagtcaggggcttgtttcc

SEQ ID NO: 350 - DNA, 25 bp, Artificial sequence
  Affy probe set ID: 227684_at
gtggctagggacatttcctggggac

SEQ ID NO: 351 - DNA, 25 bp, Artificial sequence
  Affy probe set ID: 227684_at
cgcgcgtgtgcacataggcgtgatg

SEQ ID NO: 352 - DNA, 25 bp, Artificial sequence
  Affy probe set ID: 227684_at
cataggcgtgatgtctgtgaccctc

SEQ ID NO: 353 - DNA, 25 bp, Artificial sequence
  Affy probe set ID: 227684_at
gtcacatttcccccagaatgaatgc

SEQ ID NO: 354 - DNA, 25 bp, Artificial sequence
  Affy probe set ID: 227684_at
gtgttgaagctgccaaagtcgggga

SEQ ID NO: 355 - DNA, 25 bp, Artificial sequence
  Affy probe set ID: 227684_at
ccagacccctttggaattgctggcc

SEQ ID NO: 356 - DNA, 25 bp, Artificial sequence
  Affy probe set ID: 227684_at
ccatcctcccactggagagctgggg

SEQ ID NO: 357 - DNA, 25 bp, Artificial sequence
  Affy probe set ID: 227684_at
gggtgcagctcaccttggggaagga

SEQ ID NO: 358 - DNA, 25 bp, Artificial sequence
  Affy probe set ID: 227684_at
tggggaaggaaacctcatgcctcag

SEQ ID NO: 359 - DNA, 25 bp, Artificial sequence
  Affy probe set ID: 227684_at
gtgaatgcaaagcctgggggagcgg

SEQ ID NO: 360 - DNA, 25 bp, Artificial sequence
  Affy probe set ID: 227684_at
aggagccagtcaggggcttgtttcc

SEQ ID NO: 361 - DNA, 440 bp, Artificial sequence
  Target_Sequence, Fragment of GenBank Accession No. NM_006152
  misc_feature (265)..(265): n is a, c, g, or t
  misc_feature (267)..(321): n is a, c, g, or t
  misc_feature (324)..(329): n is a, c, g, or t
  misc_feature (331)..(335): n is a, c, g, or t
  misc_feature (337)..(338): n is a, c, g, or t
  misc_feature (340)..(342): n is a, c, g, or t
  misc_feature (344)..(344): n is a, c, g, or t
  misc_feature (346)..(346): n is a, c, g, or t
  misc_feature (349)..(349): n is a, c, g, or t
  misc_feature (352)..(354): n is a, c, g, or t
  misc_feature (356)..(357): n is a, c, g, or t
  misc_feature (359)..(359): n is a, c, g, or t
  misc_feature (361)..(361): n is a, c, g, or t
ggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcangnnnnnnnnnnnnnnnnnnnnnnnnnnnnnnnnnnnnnnnnnnnnnnnnnnnnnnntannnnnntnnnnntnngnnngnanagnatnnnannanancagaggttctcagaatgactgtaagatagcttacatttcctctttttgcctttatctccccaactaaaatacaatgggg

SEQ ID NO: 362 - DNA, 25 bp, Artificial sequence
  Affy probe set ID: 35974_at
ggatgtctcttcagtttatgacaca

SEQ ID NO: 363 - DNA, 25 bp, Artificial sequence
  Affy probe set ID: 35974_at
tgacacaatagcttcctgggcaaca

SEQ ID NO: 364 - DNA, 25 bp, Artificial sequence
  Affy probe set ID: 35974_at
gctctctattgcattcattgtactg

SEQ ID NO: 365 - DNA, 25 bp, Artificial sequence
  Affy probe set ID: 35974_at
agctttgatgagcttcctcacaggc

SEQ ID NO: 366 - DNA, 25 bp, Artificial sequence
  Affy probe set ID: 35974_at
gatgagcttcctcacaggccaatta

SEQ ID NO: 367 - DNA, 25 bp, Artificial sequence
  Affy probe set ID: 35974_at
cacaggccaattattccagaagtct

SEQ ID NO: 368 - DNA, 25 bp, Artificial sequence
  Affy probe set ID: 35974_at
ccaattattccagaagtctgtggat

SEQ ID NO: 369 - DNA, 25 bp, Artificial sequence
  Affy probe set ID: 35974_at
attccagaagtctgtggatgccgct

SEQ ID NO: 370 - DNA, 25 bp, Artificial sequence
  Affy probe set ID: 35974_at
tcccacacagcaagaggactcatgg

SEQ ID NO: 371 - DNA, 25 bp, Artificial sequence
  Affy probe set ID: 35974_at
acagcaagaggactcatggacgtct

SEQ ID NO: 372 - DNA, 25 bp, Artificial sequence
  Affy probe set ID: 35974_at
agaggactcatggacgtctctagaa

SEQ ID NO: 373 - DNA, 25 bp, Artificial sequence
  Affy probe set ID: 35974_at
tctagaacatatcttgtggccattt

SEQ ID NO: 374 - DNA, 25 bp, Artificial sequence
  Affy probe set ID: 35974_at
taccagactccgacacaatgggcca

SEQ ID NO: 375 - DNA, 25 bp, Artificial sequence
  Affy probe set ID: 35974_at
gttctcagaatgactgtaagatagc

SEQ ID NO: 376 - DNA, 25 bp, Artificial sequence
  Affy probe set ID: 35974_at
ttctcagaatgactgtaagatagct

SEQ ID NO: 377 - DNA, 25 bp, Artificial sequence
  Affy probe set ID: 35974_at
tctccccaactaaaatacaatgggg

SEQ ID NO: 378 - DNA, 552 bp, Artificial sequence
  Target_Sequence, Fragment of GenBank Accession No. NM_024701
ggtttctggggcatctgaggtcaggagttcgaaaccagcctggccaacttgatgaaaccccatctctacccgttctggagaacaggtcacgcctgtcctggagacagtgtgccgggaaaagggaacgtggtactcactggatgcacccaggccggcccgagcctcccaccgcagacagtgtggaacagagtgagcctgagctgcccaaggcgatgccctttgtgctgtatgactggaggcctctccgcgtgggtacttgggggtggggccacaaatctggcgaaaaactacatgctggccgccgtgaggttttactccagcgttcccgccattgtcatggcgggtcttcgtcctaaactgagaagaaaagcattcctgtttgatcaccgccttagttaccagttctggatcagtcagtgtttctgcatggaataacaaccattaaaaaaagcactgggttctgccctttcatctttgtaagagattcttgcctctagcaatgacaacctgtgatgtctcacagtagagcacttagtgcagaatcaggtcccc

SEQ ID NO: 379 - DNA, 25 bp, Artificial sequence
  Affy probe set ID: 218862_at
ggtttctggggcatctgaggtcagg

SEQ ID NO: 380 - DNA, 25 bp, Artificial sequence
  Affy probe set ID: 218862_at
catctctacccgttctggagaacag

SEQ ID NO: 381 - DNA, 25 bp, Artificial sequence
  Affy probe set ID: 218862_at
gtcacgcctgtcctggagacagtgt

SEQ ID NO: 382 - DNA, 25 bp, Artificial sequence
  Affy probe set ID: 218862_at
aacgtggtactcactggatgcaccc

SEQ ID NO: 383 - DNA, 25 bp, Artificial sequence
  Affy probe set ID: 218862_at
cctcccaccgcagacagtgtggaac

SEQ ID NO: 384 - DNA, 25 bp, Artificial sequence
  Affy probe set ID: 218862_at
tgccctttgtgctgtatgactggag

SEQ ID NO: 385 - DNA, 25 bp, Artificial sequence
  Affy probe set ID: 218862_at
gaaaagcattcctgtttgatcaccg

SEQ ID NO: 386 - DNA, 25 bp, Artificial sequence
  Affy probe set ID: 218862_at
accgccttagttaccagttctggat

SEQ ID NO: 387 - DNA, 25 bp, Artificial sequence
  Affy probe set ID: 218862_at
ttctgccctttcatctttgtaagag

SEQ ID NO: 388 - DNA, 25 bp, Artificial sequence
  Affy probe set ID: 218862_at
tgcctctagcaatgacaacctgtga

SEQ ID NO: 389 - DNA, 25 bp, Artificial sequence
  Affy probe set ID: 218862_at
gcacttagtgcagaatcaggtcccc

SEQ ID NO: 390 - DNA, 314 bp, Artificial sequence
  Target_Sequence, Fragment of GenBank Accession No. NM_006085
acgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgc

SEQ ID NO: 391 - DNA, 25 bp, Artificial sequence
  Affy probe set ID: 232103_at
acgtttctactccaattaagaatat

SEQ ID NO: 392 - DNA, 25 bp, Artificial sequence
  Affy probe set ID: 232103_at
aatcctagctctttgttattcacca

SEQ ID NO: 393 - DNA, 25 bp, Artificial sequence
  Affy probe set ID: 232103_at
ctctttgttattcaccagcttttta

SEQ ID NO: 394 - DNA, 25 bp, Artificial sequence
  Affy probe set ID: 232103_at
aattatacattctcgactttgggga

SEQ ID NO: 395 - DNA, 25 bp, Artificial sequence
  Affy probe set ID: 232103_at
tacattctcgactttggggattagt

SEQ ID NO: 396 - DNA, 25 bp, Artificial sequence
  Affy probe set ID: 232103_at
gtggcatcattataaggcttaattg

SEQ ID NO: 397 - DNA, 25 bp, Artificial sequence
  Affy probe set ID: 232103_at
cttgcttctattccttccaatgaga

SEQ ID NO: 398 - DNA, 25 bp, Artificial sequence
  Affy probe set ID: 232103_at
gcttctattccttccaatgagagat

SEQ ID NO: 399 - DNA, 25 bp, Artificial sequence
  Affy probe set ID: 232103_at
attccttccaatgagagattataac

SEQ ID NO: 400 - DNA, 25 bp, Artificial sequence
  Affy probe set ID: 232103_at
attattctgctaatatacctagatt

SEQ ID NO: 401 - DNA, 25 bp, Artificial sequence
  Affy probe set ID: 232103_at
ttatttttaggtctctgtccattgc

SEQ ID NO: 402 - DNA, 475 bp, Artificial sequence
  Target_Sequence, Fragment of GenBank Accession No. NM_023009
agttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactt

SEQ ID NO: 403 - DNA, 25 bp, Artificial sequence
  Affy probe set ID: 200644_at
agttgaagatggtcccttacagctt

SEQ ID NO: 404 - DNA, 25 bp, Artificial sequence
  Affy probe set ID: 200644_at
ccccacccctgcataaggcagttgt

SEQ ID NO: 405 - DNA, 25 bp, Artificial sequence
  Affy probe set ID: 200644_at
gtggggtgcttatactcccaaacct

SEQ ID NO: 406 - DNA, 25 bp, Artificial sequence
  Affy probe set ID: 200644_at
actcccaaaccttgagtgtccagcc

SEQ ID NO: 407 - DNA, 25 bp, Artificial sequence
  Affy probe set ID: 200644_at
cccctgttgtttttagtctcttgtg

SEQ ID NO: 408 - DNA, 25 bp, Artificial sequence
  Affy probe set ID: 200644_at
tgctgtgcctagtggcacctgggct

SEQ ID NO: 409 - DNA, 25 bp, Artificial sequence
  Affy probe set ID: 200644_at
ttactcaagttcaaacctccagcct

SEQ ID NO: 410 - DNA, 25 bp, Artificial sequence
  Affy probe set ID: 200644_at
gcctgtgaatcaactgtgtctcttt

SEQ ID NO: 411 - DNA, 25 bp, Artificial sequence
  Affy probe set ID: 200644_at
gtgtctcttttttgacttggtaagc

SEQ ID NO: 412 - DNA, 25 bp, Artificial sequence
  Affy probe set ID: 200644_at
ttctcccactgttgtaaataacttt

SEQ ID NO: 413 - DNA, 25 bp, Artificial sequence
  Affy probe set ID: 200644_at
atggccaaaccccagatttgtactt

SEQ ID NO: 414 - DNA, 526 bp, Artificial sequence
  Target_Sequence, Fragment of GenBank Accession No. NM_033121
  misc_feature (235)..(235): n is a, c, g, or t
tgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttngtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcat

SEQ ID NO: 415 - DNA, 25 bp, Artificial sequence
  Affy probe set ID: 224810_s_at
tgtggcccgtgtattcattcccaca

SEQ ID NO: 416 - DNA, 25 bp, Artificial sequence
  Affy probe set ID: 224810_s_at
actactgttccaggtaacgtctgta

SEQ ID NO: 417 - DNA, 25 bp, Artificial sequence
  Affy probe set ID: 224810_s_at
gttgccagtgaaacgttcccagata

SEQ ID NO: 418 - DNA, 25 bp, Artificial sequence
  Affy probe set ID: 224810_s_at
gtctgaccaaaattccttctgcaca

SEQ ID NO: 419 - DNA, 25 bp, Artificial sequence
  Affy probe set ID: 224810_s_at
attccttctgcacatgaggccagta

SEQ ID NO: 420 - DNA, 25 bp, Artificial sequence
  Affy probe set ID: 224810_s_at
tgtttactttgcatttaccgtgagc

SEQ ID NO: 421 - DNA, 25 bp, Artificial sequence
  Affy probe set ID: 224810_s_at
ggaatggctgcagtgaggccgtgtc

SEQ ID NO: 422 - DNA, 25 bp, Artificial sequence
  Affy probe set ID: 224810_s_at
tgaggccgtgtcattggctcacaaa

SEQ ID NO: 423 - DNA, 25 bp, Artificial sequence
  Affy probe set ID: 224810_s_at
atttctgtgtttgcattccactgct

SEQ ID NO: 424 - DNA, 25 bp, Artificial sequence
  Affy probe set ID: 224810_s_at
gggactgagcattgtgtcaacctgt

SEQ ID NO: 425 - DNA, 25 bp, Artificial sequence
  Affy probe set ID: 224810_s_at
gtcaacctgttgcagtgtttttcat

SEQ ID NO: 426 - DNA, 403 bp, Artificial sequence
  Target_Sequence, Fragment of GenBank Accession No. NM_015187
  misc_feature (111)..(111): n is a, c, g, or t
cttacatttactcctctattagaccataagctgagtaagaggaaggccccagtcgtgtcatttgtgataactcatgcatagtaggtactcacacccacagacgactccggnctctcaagagacaagaaaactgattttttaccatctcggacggctacaaaagggtataataactcatgaaggcaaacagagacatttacaaatgggtagattaggactggacatggcattggagcatttgcgtagctgttatttctgtagcagataatggaaagtgaaaggggtgcacgtcagcgtctcttccacggtgagaaggaagtcactgttgcaagaagctaatgcgaaatcatttctctctgatttacctgaggaggttaacaaggacccatcaaaaccttccagg

SEQ ID NO: 427 - DNA, 25 bp, Artificial sequence
  Affy probe set ID: 235353_at
cttacatttactcctctattagacc

SEQ ID NO: 428 - DNA, 25 bp, Artificial sequence
  Affy probe set ID: 235353_at
gagtaagaggaaggccccagtcgtg

SEQ ID NO: 429 - DNA, 25 bp, Artificial sequence
  Affy probe set ID: 235353_at
gccccagtcgtgtcatttgtgataa

SEQ ID NO: 430 - DNA, 25 bp, Artificial sequence
  Affy probe set ID: 235353_at
atagtaggtactcacacccacagac

SEQ ID NO: 431 - DNA, 25 bp, Artificial sequence
  Affy probe set ID: 235353_at
ttttttaccatctcggacggctaca

SEQ ID NO: 432 - DNA, 25 bp, Artificial sequence
  Affy probe set ID: 235353_at
atggcattggagcatttgcgtagct

SEQ ID NO: 433 - DNA, 25 bp, Artificial sequence
  Affy probe set ID: 235353_at
atttgcgtagctgttatttctgtag

SEQ ID NO: 434 - DNA, 25 bp, Artificial sequence
  Affy probe set ID: 235353_at
cagcgtctcttccacggtgagaagg

SEQ ID NO: 435 - DNA, 25 bp, Artificial sequence
  Affy probe set ID: 235353_at
gctaatgcgaaatcatttctctctg

SEQ ID NO: 436 - DNA, 25 bp, Artificial sequence
  Affy probe set ID: 235353_at
atttctctctgatttacctgaggag

SEQ ID NO: 437 - DNA, 25 bp, Artificial sequence
  Affy probe set ID: 235353_at
caaggacccatcaaaaccttccagg

SEQ ID NO: 438 - DNA, 465 bp, Artificial sequence
  Target_Sequence, Fragment of GenBank Accession No. NM_175739
ttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaag

SEQ ID NO: 439 - DNA, 25 bp, Artificial sequence
  Affy probe set ID: 1553499_s_at
ttctgacggccatggttctggtgaa

SEQ ID NO: 440 - DNA, 25 bp, Artificial sequence
  Affy probe set ID: 1553499_s_at
gtgggagaagccctttcaccctgaa

SEQ ID NO: 441 - DNA, 25 bp, Artificial sequence
  Affy probe set ID: 1553499_s_at
aagaaagaacttcccattcctggtg

SEQ ID NO: 442 - DNA, 25 bp, Artificial sequence
  Affy probe set ID: 1553499_s_at
aggtcactgtgcatgtccccatgat

SEQ ID NO: 443 - DNA, 25 bp, Artificial sequence
  Affy probe set ID: 1553499_s_at
tacaagggagatgccgtggccttct

SEQ ID NO: 444 - DNA, 25 bp, Artificial sequence
  Affy probe set ID: 1553499_s_at
tttgtcctccctagcaagggcaaga

SEQ ID NO: 445 - DNA, 25 bp, Artificial sequence
  Affy probe set ID: 1553499_s_at
ggaacaggccttgtcagccagaaca

SEQ ID NO: 446 - DNA, 25 bp, Artificial sequence
  Affy probe set ID: 1553499_s_at
gaaagtggagccactcactccagaa

SEQ ID NO: 447 - DNA, 25 bp, Artificial sequence
  Affy probe set ID: 1553499_s_at
atagaggtgttcatccccagatttt

SEQ ID NO: 448 - DNA, 25 bp, Artificial sequence
  Affy probe set ID: 1553499_s_at
atttctgcctcctacaatctggaaa

SEQ ID NO: 449 - DNA, 25 bp, Artificial sequence
  Affy probe set ID: 1553499_s_at
agagactccctgcaggtttctaaag

SEQ ID NO: 450 - DNA, 150 bp, Artificial sequence
  Target_Sequence, Fragment of GenBank Accession No. NM_001012391
cagggagtttgggtaccagaagcttgatgtgaaaagcatcgatgatgaagatgtggatgaaaacgaagatgacgtgtatggaaactcatcaggacggaagcacaggggccactcagagtcgcccgagaaaaacggagcacactctgtcac

SEQ ID NO: 451 - DNA, 25 bp, Artificial sequence
  Affy probe set ID: 1554413_s_at
cttacatttactcctctattagacc

SEQ ID NO: 452 - DNA, 25 bp, Artificial sequence
  Affy probe set ID: 1554413_s_at
gtttgggtaccagaagcttgatgtg

SEQ ID NO: 453 - DNA, 25 bp, Artificial sequence
  Affy probe set ID: 1554413_s_at
tttgggtaccagaagcttgatgtga

SEQ ID NO: 454 - DNA, 25 bp, Artificial sequence
  Affy probe set ID: 1554413_s_at
cagagtcgcccgagaaaaacggagc

SEQ ID NO: 455 - DNA, 25 bp, Artificial sequence
  Affy probe set ID: 1554413_s_at
gagtcgcccgagaaaaacggagcac

SEQ ID NO: 456 - DNA, 25 bp, Artificial sequence
  Affy probe set ID: 1554413_s_at
agtcgcccgagaaaaacggagcaca

SEQ ID NO: 457 - DNA, 25 bp, Artificial sequence
  Affy probe set ID: 1554413_s_at
gtcgcccgagaaaaacggagcacac

SEQ ID NO: 458 - DNA, 25 bp, Artificial sequence
  Affy probe set ID: 1554413_s_at
gcccgagaaaaacggagcacactct

SEQ ID NO: 459 - DNA, 25 bp, Artificial sequence
  Affy probe set ID: 1554413_s_at
ccgagaaaaacggagcacactctgt

SEQ ID NO: 460 - DNA, 25 bp, Artificial sequence
  Affy probe set ID: 1554413_s_at
gagaaaaacggagcacactctgtca

SEQ ID NO: 461 - DNA, 25 bp, Artificial sequence
  Affy probe set ID: 1554413_s_at
agaaaaacggagcacactctgtcac

SEQ ID NO: 462 - DNA, 482 bp, Artificial sequence
  Target_Sequence, Fragment of GenBank Accession No. XM_034274
  misc_feature (68)..(68): n is a, c, g, or t
  misc_feature (70)..(71): n is a, c, g, or t
gtagcaaactcatactggatcatttcagttaccttgaactaatagcacataatggttttttgttgttntnntttttaatgtagcccttacctggatatacatagtctgcaatcaccaaagtataatatcttgtaaggctatattttttaaagcatattttttcttgagcattaaattatcctaaatggtaatatattgtggataagtctgggcttattggacataatacatatttgggttggtactggttgaatccttcagttaactgctttgttgctttttgcaagattttttatcttaaacatgtcaggcatcttaagtcacctttatactgttttgttcctctgagtttctttcagtatgttatacaaatgccagacataacatgtagcagccatacttgcatggaaactgactacacatacataatactgcattttattgtaaggttttcacattaatacagcaattaccctgactaa

SEQ ID NO: 463 - DNA, 25 bp, Artificial sequence
  Affy probe set ID: 213906_at
gtagcaaactcatactggatcattt

SEQ ID NO: 464 - DNA, 25 bp, Artificial sequence
  Affy probe set ID: 213906_at
ggatcatttcagttaccttgaacta

SEQ ID NO: 465 - DNA, 25 bp, Artificial sequence
  Affy probe set ID: 213906_at
taatgtagcccttacctggatatac

SEQ ID NO: 466 - DNA, 25 bp, Artificial sequence
  Affy probe set ID: 213906_at
atacatagtctgcaatcaccaaagt

SEQ ID NO: 467 - DNA, 25 bp, Artificial sequence
  Affy probe set ID: 213906_at
gggttggtactggttgaatccttca

SEQ ID NO: 468 - DNA, 25 bp, Artificial sequence
  Affy probe set ID: 213906_at
gttaactgctttgttgctttttgca

SEQ ID NO: 469 - DNA, 25 bp, Artificial sequence
  Affy probe set ID: 213906_at
gtcaggcatcttaagtcacctttat

SEQ ID NO: 470 - DNA, 25 bp, Artificial sequence
  Affy probe set ID: 213906_at
taacatgtagcagccatacttgcat

SEQ ID NO: 471 - DNA, 25 bp, Artificial sequence
  Affy probe set ID: 213906_at
atacttgcatggaaactgactacac

SEQ ID NO: 472 - DNA, 25 bp, Artificial sequence
  Affy probe set ID: 213906_at
gactacacatacataatactgcatt

SEQ ID NO: 473 - DNA, 25 bp, Artificial sequence
  Affy probe set ID: 213906_at
ttaatacagcaattaccctgactaa

SEQ ID NO: 474 - DNA, 420 bp, Artificial sequence
  Target_Sequence, Fragment of GenBank Accession No. NM_024579
tttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctagtccagatctgaacgatgccgtgtccagtttgcgaagtcctattcccctcctcctgtcgcgtgcctttgttcaggtggggatgtatttcatgtagaaggtggaagaaggctgctatgactctttggatggg

SEQ ID NO: 475 - DNA, 25 bp, Artificial sequence
  Affy probe set ID: 219506_at
tttgtagccatctttgctgtgccac

SEQ ID NO: 476 - DNA, 25 bp, Artificial sequence
  Affy probe set ID: 219506_at
ctgtgccacttatcctgggacaaga

SEQ ID NO: 477 - DNA, 25 bp, Artificial sequence
  Affy probe set ID: 219506_at
ttatacagtcacccccagttatgat

SEQ ID NO: 478 - DNA, 25 bp, Artificial sequence
  Affy probe set ID: 219506_at
gcagatttcaccattgattactcca

SEQ ID NO: 479 - DNA, 25 bp, Artificial sequence
  Affy probe set ID: 219506_at
tgaaacagcacgtgcagaccatccg

SEQ ID NO: 480 - DNA, 25 bp, Artificial sequence
  Affy probe set ID: 219506_at
gcagaccatccgaagcctgtaactg

SEQ ID NO: 481 - DNA, 25 bp, Artificial sequence
  Affy probe set ID: 219506_at
aacggaacctagtccagatctgaac

SEQ ID NO: 482 - DNA, 25 bp, Artificial sequence
  Affy probe set ID: 219506_at
gatctgaacgatgccgtgtccagtt

SEQ ID NO: 483 - DNA, 25 bp, Artificial sequence
  Affy probe set ID: 219506_at
gtgtccagtttgcgaagtcctattc

SEQ ID NO: 484 - DNA, 25 bp, Artificial sequence
  Affy probe set ID: 219506_at
gcgtgcctttgttcaggtggggatg

SEQ ID NO: 485 - DNA, 25 bp, Artificial sequence
  Affy probe set ID: 219506_at
aggctgctatgactctttggatggg

SEQ ID NO: 486 - DNA, 442 bp, Artificial sequence
  Target_Sequence, Fragment of GenBank Accession No. NM_001645
  misc_feature (140)..(140): n is a, c, g, or t
  misc_feature (148)..(148): n is a, c, g, or t
  misc_feature (155)..(155): n is a, c, g, or t
  misc_feature (165)..(165): n is a, c, g, or t
gagaactgcttgaacctaggaggcggaggttgcagtaagccgagatcgcaccatttgacacagcaagtctccgtctcaaaactacaacaacaacaacaacaacaaccaaattttgcacccctgcctcatcttcctggcanggcccagnccccagncccagggganccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaa

SEQ ID NO: 487 - DNA, 25 bp, Artificial sequence
  Affy probe set ID: 213553_x_at
gagaactgcttgaacctaggaggcg

SEQ ID NO: 488 - DNA, 25 bp, Artificial sequence
  Affy probe set ID: 213553_x_at
cgagatcgcaccatttgacacagca

SEQ ID NO: 489 - DNA, 25 bp, Artificial sequence
  Affy probe set ID: 213553_x_at
ccatttgacacagcaagtctccgtc

SEQ ID NO: 490 - DNA, 25 bp, Artificial sequence
  Affy probe set ID: 213553_x_at
gtctccgtctcaaaactacaacaac

SEQ ID NO: 491 - DNA, 25 bp, Artificial sequence
  Affy probe set ID: 213553_x_at
caacaaccaaattttgcacccctgc

SEQ ID NO: 492 - DNA, 25 bp, Artificial sequence
  Affy probe set ID: 213553_x_at
gacgtctccagtgccttggataagc

SEQ ID NO: 493 - DNA, 25 bp, Artificial sequence
  Affy probe set ID: 213553_x_at
caaggctcgggaactcatcagccgc

SEQ ID NO: 494 - DNA, 25 bp, Artificial sequence
  Affy probe set ID: 213553_x_at
gtgaactttctgccaagatgcggga

SEQ ID NO: 495 - DNA, 25 bp, Artificial sequence
  Affy probe set ID: 213553_x_at
gaagggtgacatcccaggaggggcc

SEQ ID NO: 496 - DNA, 25 bp, Artificial sequence
  Affy probe set ID: 213553_x_at
caggaggggcctctgaaatttccca

SEQ ID NO: 497 - DNA, 25 bp, Artificial sequence
  Affy probe set ID: 213553_x_at
tggccccaggtgccaccaataaaaa

SEQ ID NO: 498 - DNA, 459 bp, Artificial sequence
  Target_Sequence, Fragment of GenBank Accession No. NM_001562
ggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatactaaaaattagctgagtgtagtgacgcatgccctcaatcccagctactcaagaggctgaggcaggagaatcacttgcactccggaggtagaggtt

SEQ ID NO: 499 - DNA, 25 bp, Artificial sequence
  Affy probe set ID: 206295_at
ggaaatgaatcctcctgataacatc

SEQ ID NO: 500 - DNA, 25 bp, Artificial sequence
  Affy probe set ID: 206295_at
tattctttcagagaagtgtcccagg

SEQ ID NO: 501 - DNA, 25 bp, Artificial sequence
  Affy probe set ID: 206295_at
gtgtcccaggacatgataataagat

SEQ ID NO: 502 - DNA, 25 bp, Artificial sequence
  Affy probe set ID: 206295_at
gatgcaatttgaatcttcatcatac

SEQ ID NO: 503 - DNA, 25 bp, Artificial sequence
  Affy probe set ID: 206295_at
catcatacgaaggatactttctagc

SEQ ID NO: 504 - DNA, 25 bp, Artificial sequence
  Affy probe set ID: 206295_at
gatagatctataatgttcactgttc

SEQ ID NO: 505 - DNA, 25 bp, Artificial sequence
  Affy probe set ID: 206295_at
gttcaaaacgaagactagctattaa

SEQ ID NO: 506 - DNA, 25 bp, Artificial sequence
  Affy probe set ID: 206295_at
ctattaaaatttcatgccgggcgca

SEQ ID NO: 507 - DNA, 25 bp, Artificial sequence
  Affy probe set ID: 206295_at
tgagtgtagtgacgcatgccctcaa

SEQ ID NO: 508 - DNA, 25 bp, Artificial sequence
  Affy probe set ID: 206295_at
gaatcacttgcactccggaggtaga

SEQ ID NO: 509 - DNA, 25 bp, Artificial sequence
  Affy probe set ID: 206295_at
cacttgcactccggaggtagaggtt

SEQ ID NO: 510 - DNA, 529 bp, Artificial sequence
  Target_Sequence, Fragment of GenBank Accession No. NM_014479
ctttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcgagaatgattcaatgtaaatatttttcattttatcatgtatatcctatacacacatctccttcatcatcatatatgaagtttattttgagaagtctacattgcttacattt

SEQ ID NO: 511 - DNA, 25 bp, Artificial sequence
  Affy probe set ID: 206134_at
ctttctatattgttatcagtccagg

SEQ ID NO: 512 - DNA, 25 bp, Artificial sequence
  Affy probe set ID: 206134_at
gacattggctctttgtttaggccta

SEQ ID NO: 513 - DNA, 25 bp, Artificial sequence
  Affy probe set ID: 206134_at
gaatttgtgacttagttctgccctt

SEQ ID NO: 514 - DNA, 25 bp, Artificial sequence
  Affy probe set ID: 206134_at
gaaagcagtcttccatcaaatcacc

SEQ ID NO: 515 - DNA, 25 bp, Artificial sequence
  Affy probe set ID: 206134_at
aatgcacggctaaactattcagagt

SEQ ID NO: 516 - DNA, 25 bp, Artificial sequence
  Affy probe set ID: 206134_at
aagtactatgctttaatgcttcttt

SEQ ID NO: 517 - DNA, 25 bp, Artificial sequence
  Affy probe set ID: 206134_at
gcttctttcatcttactagtatggc

SEQ ID NO: 518 - DNA, 25 bp, Artificial sequence
  Affy probe set ID: 206134_at
tatgttattcctctgtgttcacttc

SEQ ID NO: 519 - DNA, 25 bp, Artificial sequence
  Affy probe set ID: 206134_at
acttcgccttgctcttgaaagtgca

SEQ ID NO: 520 - DNA, 25 bp, Artificial sequence
  Affy probe set ID: 206134_at
gtatatcctatacacacatctcctt

SEQ ID NO: 521 - DNA, 25 bp, Artificial sequence
  Affy probe set ID: 206134_at
tgagaagtctacattgcttacattt

SEQ ID NO: 522 - DNA, 270 bp, Artificial sequence
  Target_Sequence, Fragment of GenBank Accession No. NM_003465
ttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcagcggggcggctgttccagcaaagctgcccgacaggcctggtgttcagcaactcctgcaaatgctgcacctggaattgagtcgtaaagcccctccagtccagctttgaggctgggcccag

SEQ ID NO: 523 - DNA, 25 bp, Artificial sequence
  Affy probe set ID: 208168_s_at
ttcaggcaccccagagcttgaagtt

SEQ ID NO: 524 - DNA, 25 bp, Artificial sequence
  Affy probe set ID: 208168_s_at
gaagttccaaaaccaggtcagccct

SEQ ID NO: 525 - DNA, 25 bp, Artificial sequence
  Affy probe set ID: 208168_s_at
cagccctggacaagacacgttctgc

SEQ ID NO: 526 - DNA, 25 bp, Artificial sequence
  Affy probe set ID: 208168_s_at
caagacacgttctgccagggcaaag

SEQ ID NO: 527 - DNA, 25 bp, Artificial sequence
  Affy probe set ID: 208168_s_at
ttctgccagggcaaagctgatgggc

SEQ ID NO: 528 - DNA, 25 bp, Artificial sequence
  Affy probe set ID: 208168_s_at
agctgatgggctctatcccaatcct

SEQ ID NO: 529 - DNA, 25 bp, Artificial sequence
  Affy probe set ID: 208168_s_at
tatcccaatcctcgggaacggtcca

SEQ ID NO: 530 - DNA, 25 bp, Artificial sequence
  Affy probe set ID: 208168_s_at
gtccagcttctacagctgtgcagcg

SEQ ID NO: 531 - DNA, 25 bp, Artificial sequence
  Affy probe set ID: 208168_s_at
aactcctgcaaatgctgcacctgga

SEQ ID NO: 532 - DNA, 25 bp, Artificial sequence
  Affy probe set ID: 208168_s_at
ggaattgagtcgtaaagcccctcca

SEQ ID NO: 533 - DNA, 25 bp, Artificial sequence
  Affy probe set ID: 208168_s_at
agtccagctttgaggctgggcccag

SEQ ID NO: 534 - DNA, 551 bp, Artificial sequence
  Target_Sequence, Fragment of GenBank Accession No. NM_000954
gaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactc

SEQ ID NO: 535 - DNA, 25 bp, Artificial sequence
  Affy probe set ID: 211748_x_at
gaagaaggcggcgttgtccatgtgc

SEQ ID NO: 536 - DNA, 25 bp, Artificial sequence
  Affy probe set ID: 211748_x_at
ccatgtgcaagtctgtggtggcccc

SEQ ID NO: 537 - DNA, 25 bp, Artificial sequence
  Affy probe set ID: 211748_x_at
aaaaccagtgtgagacccgaaccat

SEQ ID NO: 538 - DNA, 25 bp, Artificial sequence
  Affy probe set ID: 211748_x_at
gcacctactccgtgtcagtggtgga

SEQ ID NO: 539 - DNA, 25 bp, Artificial sequence
  Affy probe set ID: 211748_x_at
cgcgctgctgtacagccagggcagc

SEQ ID NO: 540 - DNA, 25 bp, Artificial sequence
  Affy probe set ID: 211748_x_at
aaaggagaaattcaccgccttctgc

SEQ ID NO: 541 - DNA, 25 bp, Artificial sequence
  Affy probe set ID: 211748_x_at
ccttctgcaaggcccagggcttcac

SEQ ID NO: 542 - DNA, 25 bp, Artificial sequence
  Affy probe set ID: 211748_x_at
cagaggataccattgtcttcctgcc

SEQ ID NO: 543 - DNA, 25 bp, Artificial sequence
  Affy probe set ID: 211748_x_at
ttcctgccccaaaccgataagtgca

SEQ ID NO: 544 - DNA, 25 bp, Artificial sequence
  Affy probe set ID: 211748_x_at
aataggactccccagggctgaagct

SEQ ID NO: 545 - DNA, 25 bp, Artificial sequence
  Affy probe set ID: 211748_x_at
gggcttcatcctgcacaataaactc

SEQ ID NO: 546 - DNA, 132 bp, Artificial sequence
  Target_Sequence, Fragment of GenBank Accession No. NM_001056
ttcagtcccagccagaagaatctctgaaagcatattgtgaatgtatacaatgtagtacaaacaatctctgtgatgattaacagtatgtcaccacttcattttttaaaaaggatcacgtctaatgcccatttt

SEQ ID NO: 547 - DNA, 25 bp, Artificial sequence
  Affy probe set ID: 211470_s_at
ttcagtcccagccagaagaatctct

SEQ ID NO: 548 - DNA, 25 bp, Artificial sequence
  Affy probe set ID: 211470_s_at
gtcccagccagaagaatctctgaaa

SEQ ID NO: 549 - DNA, 25 bp, Artificial sequence
  Affy probe set ID: 211470_s_at
gaatctctgaaagcatattgtgaat

SEQ ID NO: 550 - DNA, 25 bp, Artificial sequence
  Affy probe set ID: 211470_s_at
acaatgtagtacaaacaatctctgt

SEQ ID NO: 551 - DNA, 25 bp, Artificial sequence
  Affy probe set ID: 211470_s_at
gtagtacaaacaatctctgtgatga

SEQ ID NO: 552 - DNA, 25 bp, Artificial sequence
  Affy probe set ID: 211470_s_at
aacaatctctgtgatgattaacagt

SEQ ID NO: 553 - DNA, 25 bp, Artificial sequence
  Affy probe set ID: 211470_s_at
gattaacagtatgtcaccacttcat

SEQ ID NO: 554 - DNA, 25 bp, Artificial sequence
  Affy probe set ID: 211470_s_at
aacagtatgtcaccacttcattttt

SEQ ID NO: 555 - DNA, 25 bp, Artificial sequence
  Affy probe set ID: 211470_s_at
cagtatgtcaccacttcatttttta

SEQ ID NO: 556 - DNA, 25 bp, Artificial sequence
  Affy probe set ID: 211470_s_at
aaaaggatcacgtctaatgcccatt

SEQ ID NO: 557 - DNA, 25 bp, Artificial sequence
  Affy probe set ID: 211470_s_at
aaggatcacgtctaatgcccatttt

SEQ ID NO: 558 - DNA, 553 bp, Artificial sequence
  Target_Sequence, Fragment of GenBank Accession No. NM_018000
gcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaacaatggaaatatttttatttttacagattttgcacttctgaattcaggttaaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgc

SEQ ID NO: 559 - DNA, 25 bp, Artificial sequence
  Affy probe set ID: 219648_at
gcactgaagatctttgctggacctt

SEQ ID NO: 560 - DNA, 25 bp, Artificial sequence
  Affy probe set ID: 219648_at
ctggaccttcttctcttcagaagat

SEQ ID NO: 561 - DNA, 25 bp, Artificial sequence
  Affy probe set ID: 219648_at
atgctgtgaatgcagcttgcttctc

SEQ ID NO: 562 - DNA, 25 bp, Artificial sequence
  Affy probe set ID: 219648_at
gtccagcttcaaaagttacttgcca

SEQ ID NO: 563 - DNA, 25 bp, Artificial sequence
  Affy probe set ID: 219648_at
agattttgcacttctgaattcaggt

SEQ ID NO: 564 - DNA, 25 bp, Artificial sequence
  Affy probe set ID: 219648_at
tctgcttagaggactgtgacttgaa

SEQ ID NO: 565 - DNA, 25 bp, Artificial sequence
  Affy probe set ID: 219648_at
tgagctttttggtagcgtccacaat

SEQ ID NO: 566 - DNA, 25 bp, Artificial sequence
  Affy probe set ID: 219648_at
ataggcgagatccgtgttctccatt

SEQ ID NO: 567 - DNA, 25 bp, Artificial sequence
  Affy probe set ID: 219648_at
tgtagaccaatttaactgctgtgtt

SEQ ID NO: 568 - DNA, 25 bp, Artificial sequence
  Affy probe set ID: 219648_at
ttagtgcttaatctttgcctcatgt

SEQ ID NO: 569 - DNA, 25 bp, Artificial sequence
  Affy probe set ID: 219648_at
ttctctcaattctgtagactctcgc

SEQ ID NO: 570 - DNA, 469 bp, Artificial sequence
  Target_Sequence, Fragment of GenBank Accession No. NM_001018058
aaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtaga

SEQ ID NO: 571 - DNA, 25 bp, Artificial sequence
  Affy probe set ID: 206715_at
aaacagacccaattcatcaactgga

SEQ ID NO: 572 - DNA, 25 bp, Artificial sequence
  Affy probe set ID: 206715_at
gcaattctatgctggtgctatgcaa

SEQ ID NO: 573 - DNA, 25 bp, Artificial sequence
  Affy probe set ID: 206715_at
gctatgcaattatgctctgtgtttc

SEQ ID NO: 574 - DNA, 25 bp, Artificial sequence
  Affy probe set ID: 206715_at
gtgtttcatatgttgctttggctta

SEQ ID NO: 575 - DNA, 25 bp, Artificial sequence
  Affy probe set ID: 206715_at
gactacggagtccaaatccacttaa

SEQ ID NO: 576 - DNA, 25 bp, Artificial sequence
  Affy probe set ID: 206715_at
agcagcaacttggtggtgtactact

SEQ ID NO: 577 - DNA, 25 bp, Artificial sequence
  Affy probe set ID: 206715_at
ggtgtactactggaactaatgactg

SEQ ID NO: 578 - DNA, 25 bp, Artificial sequence
  Affy probe set ID: 206715_at
tcttagttactcatttccatcttct

SEQ ID NO: 579 - DNA, 25 bp, Artificial sequence
  Affy probe set ID: 206715_at
ttcaactttcacatcagtcttccgg

SEQ ID NO: 580 - DNA, 25 bp, Artificial sequence
  Affy probe set ID: 206715_at
catatcaggtggtcattgcctttct

SEQ ID NO: 581 - DNA, 25 bp, Artificial sequence
  Affy probe set ID: 206715_at
ttgcctttctccattgtctagtaga

SEQ ID NO: 582 - DNA, 419 bp, Artificial sequence
  Target_Sequence, Fragment of GenBank Accession No. NM_000239
  misc_feature (30)..(30): n is a, c, g, or t
  misc_feature (53)..(53): n is a, c, g, or t
  misc_feature (55)..(55): n is a, c, g, or t
  misc_feature (248)..(248): n is a, c, g, or t
gaaataacccagacttaatcttgaatgatncgattatgcccaatattaagtananaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttnttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctt

SEQ ID NO: 583 - DNA, 25 bp, Artificial sequence
  Affy probe set ID: 213975_s_at
gaaataacccagacttaatcttgaa

SEQ ID NO: 584 - DNA, 25 bp, Artificial sequence
  Affy probe set ID: 213975_s_at
taacccagacttaatcttgaatgat

SEQ ID NO: 585 - DNA, 25 bp, Artificial sequence
  Affy probe set ID: 213975_s_at
tctgatgccttcatctgttcagtca

SEQ ID NO: 586 - DNA, 25 bp, Artificial sequence
  Affy probe set ID: 213975_s_at
cttcatctgttcagtcatctccaaa

SEQ ID NO: 587 - DNA, 25 bp, Artificial sequence
  Affy probe set ID: 213975_s_at
ataaccactttttgttgggcaatat

SEQ ID NO: 588 - DNA, 25 bp, Artificial sequence
  Affy probe set ID: 213975_s_at
caaatgatagaaacagactgcctga

SEQ ID NO: 589 - DNA, 25 bp, Artificial sequence
  Affy probe set ID: 213975_s_at
aacagactgcctgaattgagaattt

SEQ ID NO: 590 - DNA, 25 bp, Artificial sequence
  Affy probe set ID: 213975_s_at
gtttctttctaaattgctgttcctt

SEQ ID NO: 591 - DNA, 25 bp, Artificial sequence
  Affy probe set ID: 213975_s_at
attgctgttccttaatttgattaat

SEQ ID NO: 592 - DNA, 25 bp, Artificial sequence
  Affy probe set ID: 213975_s_at
ggcagatgagcttacaagtattgaa

SEQ ID NO: 593 - DNA, 25 bp, Artificial sequence
  Affy probe set ID: 213975_s_at
atacaaacattctaattaaaggctt

SEQ ID NO: 594 - DNA, 527 bp, Artificial sequence
  Target_Sequence, Fragment of GenBank Accession No. NM_006834
agttccacatttgaggcagtcttaaaatggaaaagtgatctggatagtaaagttcatcttccaaatggcagccctatccctgctgtcctcttggctaacaaatgtgaccagaacaaggacagtagccagagtccttcccaggtggaccaattctgcaaagaacatggctttgccggatggtttgaaacctctgcaaaggataacataaacatagaggaagctgcccggttcctagtggagaagattcttgtaaaccaccaaagctttcctaatgaagaaaacgatgtggacaaaattaagctagatcaagagaccttgagagcagagaacaaatcccagtgttgctgatatatggcttctgcttctcttgtgtgtgcctcagctctgaagaagttcctgagaatgggttacagatgtcatgttagctgggagtcttcccacatgtggcacttcaaaaggcagcaccactgggcgcctgcacttatttgaaaatggaactttgggagaagtatccctgctagtggctc

SEQ ID NO: 595 - DNA, 25 bp, Artificial sequence
  Affy probe set ID: 204214_s_at
agttccacatttgaggcagtcttaa

SEQ ID NO: 596 - DNA, 25 bp, Artificial sequence
  Affy probe set ID: 204214_s_at
atcttccaaatggcagccctatccc

SEQ ID NO: 597 - DNA, 25 bp, Artificial sequence
  Affy probe set ID: 204214_s_at
aggacagtagccagagtccttccca

SEQ ID NO: 598 - DNA, 25 bp, Artificial sequence
  Affy probe set ID: 204214_s_at
gtccttcccaggtggaccaattctg

SEQ ID NO: 599 - DNA, 25 bp, Artificial sequence
  Affy probe set ID: 204214_s_at
ggctttgccggatggtttgaaacct

SEQ ID NO: 600 - DNA, 25 bp, Artificial sequence
  Affy probe set ID: 204214_s_at
ctgcccggttcctagtggagaagat

SEQ ID NO: 601 - DNA, 25 bp, Artificial sequence
  Affy probe set ID: 204214_s_at
gctgatatatggcttctgcttctct

SEQ ID NO: 602 - DNA, 25 bp, Artificial sequence
  Affy probe set ID: 204214_s_at
tgtcatgttagctgggagtcttccc

SEQ ID NO: 603 - DNA, 25 bp, Artificial sequence
  Affy probe set ID: 204214_s_at
gtcttcccacatgtggcacttcaaa

SEQ ID NO: 604 - DNA, 25 bp, Artificial sequence
  Affy probe set ID: 204214_s_at
caaaaggcagcaccactgggcgcct

SEQ ID NO: 605 - DNA, 25 bp, Artificial sequence
  Affy probe set ID: 204214_s_at
ggagaagtatccctgctagtggctc

SEQ ID NO: 606 - DNA, 258 bp, Artificial sequence
  Target_Sequence, Fragment of GenBank Accession No. NM_000416
aagcgtaaagaggatgtgtggcattttcacttttggcttgtaaagtacagacttttttttttttttaaacaaaaaaagcattgtaacttatgaacctttacatccagataggttaccagtaacggaacatatccagtactcctggttcctaggtgagcaggtgatgccccagggacctttgtagccacttcactttttttcttttctctgccttggtatagcatatgtgttttgtaagtttatgcatacagtaatttt

SEQ ID NO: 607 - DNA, 25 bp, Artificial sequence
  Affy probe set ID: 202727_s_at
aagcgtaaagaggatgtgtggcatt

SEQ ID NO: 608 - DNA, 25 bp, Artificial sequence
  Affy probe set ID: 202727_s_at
gtgtggcattttcacttttggcttg

SEQ ID NO: 609 - DNA, 25 bp, Artificial sequence
  Affy probe set ID: 202727_s_at
ggcattttcacttttggcttgtaaa

SEQ ID NO: 610 - DNA, 25 bp, Artificial sequence
  Affy probe set ID: 202727_s_at
aagcattgtaacttatgaaccttta

SEQ ID NO: 611 - DNA, 25 bp, Artificial sequence
  Affy probe set ID: 202727_s_at
acttatgaacctttacatccagata

SEQ ID NO: 612 - DNA, 25 bp, Artificial sequence
  Affy probe set ID: 202727_s_at
catccagataggttaccagtaacgg

SEQ ID NO: 613 - DNA, 25 bp, Artificial sequence
  Affy probe set ID: 202727_s_at
tatccagtactcctggttcctaggt

SEQ ID NO: 614 - DNA, 25 bp, Artificial sequence
  Affy probe set ID: 202727_s_at
gtactcctggttcctaggtgagcag

SEQ ID NO: 615 - DNA, 25 bp, Artificial sequence
  Affy probe set ID: 202727_s_at
taggtgagcaggtgatgccccaggg

SEQ ID NO: 616 - DNA, 25 bp, Artificial sequence
  Affy probe set ID: 202727_s_at
tttctctgccttggtatagcatatg

SEQ ID NO: 617 - DNA, 25 bp, Artificial sequence
  Affy probe set ID: 202727_s_at
gtaagtttatgcatacagtaatttt

SEQ ID NO: 618 - DNA, 471 bp, Artificial sequence
  Target_Sequence, Fragment of GenBank Accession No. NM_004666
gaaaaccagagagtcccattttaagaaattagatatttaatatagcattgtgtgttctattttagtaacagcagaatctcttgacattacacaactcagtgaaacaacatcatttaagccaaaatatctcccaactgactgatagactctgagcactaatatcatagtgctgtgatgatggacaattacatagtaccgataacagccatgcactgtgcaaagcatgcccttctgcacaggagagcaaggcacttgcagtagtgatctatgccagcaaaacatcattttgagacaaacatttttgtggcagatgtttttcctaaaaagtactatatcatccaagaaatatttgagtaaaatcccttgttcttttgggtgacattaactgacatttgctttttttcaagacctaatagaaaataagaaagcccataatgtatttagaaacaggaatcctcagagcaattctct

SEQ ID NO: 619 - DNA, 25 bp, Artificial sequence
  Affy probe set ID: 205844_at
gaaaaccagagagtcccattttaag

SEQ ID NO: 620 - DNA, 25 bp, Artificial sequence
  Affy probe set ID: 205844_at
gtaacagcagaatctcttgacatta

SEQ ID NO: 621 - DNA, 25 bp, Artificial sequence
  Affy probe set ID: 205844_at
gccaaaatatctcccaactgactga

SEQ ID NO: 622 - DNA, 25 bp, Artificial sequence
  Affy probe set ID: 205844_at
aactgactgatagactctgagcact

SEQ ID NO: 623 - DNA, 25 bp, Artificial sequence
  Affy probe set ID: 205844_at
atagtaccgataacagccatgcact

SEQ ID NO: 624 - DNA, 25 bp, Artificial sequence
  Affy probe set ID: 205844_at
ctgcacaggagagcaaggcacttgc

SEQ ID NO: 625 - DNA, 25 bp, Artificial sequence
  Affy probe set ID: 205844_at
cttgcagtagtgatctatgccagca

SEQ ID NO: 626 - DNA, 25 bp, Artificial sequence
  Affy probe set ID: 205844_at
ttttgtggcagatgtttttcctaaa

SEQ ID NO: 627 - DNA, 25 bp, Artificial sequence
  Affy probe set ID: 205844_at
tgagtaaaatcccttgttcttttgg

SEQ ID NO: 628 - DNA, 25 bp, Artificial sequence
  Affy probe set ID: 205844_at
gggtgacattaactgacatttgctt

SEQ ID NO: 629 - DNA, 25 bp, Artificial sequence
  Affy probe set ID: 205844_at
acaggaatcctcagagcaattctct

SEQ ID NO: 630 - DNA, 562 bp, Artificial sequence
  Target_Sequence, Fragment of GenBank Accession No. NM_031491
ctacctgcaagccctaaacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccagaccatagtaacctgggaggaggagcacctggtgtgtgtgcagaaaggggaggtccccaaccggggctggagacactggctggagggagagatgctgtatctggaactgactgcaagggatgcagtgtgcgagcaggtcttcaggaaggtcagatagccggagaggagccaagatccctccagacagcaccagctcacagacgctcttgttgtgcccccttcaagcccagattgtgccaggtcagctgtcccttcctctggccacctttcctccctctgggtccctcctcacccctccccgtgttaatctgtaacttgcagcccccaggccaaagtcctttctcacactccactgcccaatagtgac

SEQ ID NO: 631 - DNA, 25 bp, Artificial sequence
  Affy probe set ID: 223820_at
ctacctgcaagccctaaacatcagc

SEQ ID NO: 632 - DNA, 25 bp, Artificial sequence
  Affy probe set ID: 223820_at
tcagcttggctgtgcggaagatcgc

SEQ ID NO: 633 - DNA, 25 bp, Artificial sequence
  Affy probe set ID: 223820_at
aacaccagggcaaccacatgacggt

SEQ ID NO: 634 - DNA, 25 bp, Artificial sequence
  Affy probe set ID: 223820_at
tgacggtgaggacgctcagcacctt

SEQ ID NO: 635 - DNA, 25 bp, Artificial sequence
  Affy probe set ID: 223820_at
tcagcaccttccgaaactacactgt

SEQ ID NO: 636 - DNA, 25 bp, Artificial sequence
  Affy probe set ID: 223820_at
gacctcaggagcgtggacggacgaa

SEQ ID NO: 637 - DNA, 25 bp, Artificial sequence
  Affy probe set ID: 223820_at
gtccccaaccggggctggagacact

SEQ ID NO: 638 - DNA, 25 bp, Artificial sequence
  Affy probe set ID: 223820_at
gctgtatctggaactgactgcaagg

SEQ ID NO: 639 - DNA, 25 bp, Artificial sequence
  Affy probe set ID: 223820_at
gatgcagtgtgcgagcaggtcttca

SEQ ID NO: 640 - DNA, 25 bp, Artificial sequence
  Affy probe set ID: 223820_at
agctcacagacgctcttgttgtgcc

SEQ ID NO: 641 - DNA, 25 bp, Artificial sequence
  Affy probe set ID: 223820_at
tcacactccactgcccaatagtgac

SEQ ID NO: 642 - DNA, 473 bp, Artificial sequence
  Target_Sequence, Fragment of GenBank Accession No. NM_001276
tcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgatgattaatggaaatgtttacagatccccaagcctggcaagggaatttcttcaactccctgccccctagccctccttatcaaaggacaccattttggcaagctctatcaccaaggagccaaacatcctacaagacacagtgaccatactaattataccccctgcaaagccagcttgaaaccttcact

SEQ ID NO: 643 - DNA, 25 bp, Artificial sequence
  Affy probe set ID: 209396_s_at
tcaccaatgccatcaaggatgcact

SEQ ID NO: 644 - DNA, 25 bp, Artificial sequence
  Affy probe set ID: 209396_s_at
caaggatgcactcgctgcaacgtag

SEQ ID NO: 645 - DNA, 25 bp, Artificial sequence
  Affy probe set ID: 209396_s_at
cacacagcacgggggccaaggatgc

SEQ ID NO: 646 - DNA, 25 bp, Artificial sequence
  Affy probe set ID: 209396_s_at
tgcagaggtccacaacacacagatt

SEQ ID NO: 647 - DNA, 25 bp, Artificial sequence
  Affy probe set ID: 209396_s_at
cacagatttgagctcagccctggtg

SEQ ID NO: 648 - DNA, 25 bp, Artificial sequence
  Affy probe set ID: 209396_s_at
ccctagccctccttatcaaaggaca

SEQ ID NO: 649 - DNA, 25 bp, Artificial sequence
  Affy probe set ID: 209396_s_at
aaggacaccattttggcaagctcta

SEQ ID NO: 650 - DNA, 25 bp, Artificial sequence
  Affy probe set ID: 209396_s_at
ggcaagctctatcaccaaggagcca

SEQ ID NO: 651 - DNA, 25 bp, Artificial sequence
  Affy probe set ID: 209396_s_at
atcctacaagacacagtgaccatac

SEQ ID NO: 652 - DNA, 25 bp, Artificial sequence
  Affy probe set ID: 209396_s_at
agtgaccatactaattataccccct

SEQ ID NO: 653 - DNA, 25 bp, Artificial sequence
  Affy probe set ID: 209396_s_at
gcaaagccagcttgaaaccttcact

SEQ ID NO: 654 - DNA, 459 bp, Artificial sequence
  Target_Sequence, Fragment of GenBank Accession No. NM_138434
cacacactcatcatggattgctcagagttcctttagggcagagctgagggcctgggatccaggaaccagtgggattggatgggagaagaaggaagggggtggcccgtcacccccgcaagacttgcatccaggtagcctaaggactcctggtcactgggtagggtggctgctgagatgcaggtcggaagaggcaggggaaggctccaggcctaacttggagcatgtcactggccatgggggtgaggggacagactctgctctcactggctggcagccccaggagcctgttcccttgcctctcctggatgggttgtcagccctgtgtttcactgtgaccaattcattataacatttggatattactgaaaatgtaaggaagcaggaaaaattaactactttcattcagagatagcctctatcaatagtttgacatttttccctcttttacattgagatcat

SEQ ID NO: 655 - DNA, 25 bp, Artificial sequence
  Affy probe set ID: 227598_at
cacacactcatcatggattgctcag

SEQ ID NO: 656 - DNA, 25 bp, Artificial sequence
  Affy probe set ID: 227598_at
tcagagttcctttagggcagagctg

SEQ ID NO: 657 - DNA, 25 bp, Artificial sequence
  Affy probe set ID: 227598_at
gcaagacttgcatccaggtagccta

SEQ ID NO: 658 - DNA, 25 bp, Artificial sequence
  Affy probe set ID: 227598_at
gtagcctaaggactcctggtcactg

SEQ ID NO: 659 - DNA, 25 bp, Artificial sequence
  Affy probe set ID: 227598_at
cctggtcactgggtagggtggctgc

SEQ ID NO: 660 - DNA, 25 bp, Artificial sequence
  Affy probe set ID: 227598_at
aagaggcaggggaaggctccaggcc

SEQ ID NO: 661 - DNA, 25 bp, Artificial sequence
  Affy probe set ID: 227598_at
ggcctaacttggagcatgtcactgg

SEQ ID NO: 662 - DNA, 25 bp, Artificial sequence
  Affy probe set ID: 227598_at
tcctggatgggttgtcagccctgtg

SEQ ID NO: 663 - DNA, 25 bp, Artificial sequence
  Affy probe set ID: 227598_at
agccctgtgtttcactgtgaccaat

SEQ ID NO: 664 - DNA, 25 bp, Artificial sequence
  Affy probe set ID: 227598_at
caatagtttgacatttttccctctt

SEQ ID NO: 665 - DNA, 25 bp, Artificial sequence
  Affy probe set ID: 227598_at
tttccctcttttacattgagatcat

SEQ ID NO: 666 - DNA, 459 bp, Artificial sequence
  Target_Sequence, Fragment of GenBank Accession No. NM_001005340
agaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtatagtcgctgcacatatttgaaatcatatattaagactttccaaagatgaggtccctggtttttcatggcaacttgatcagtaaggatttcacctctgtttgtaacta

SEQ ID NO: 667 - DNA, 25 bp, Artificial sequence
  Affy probe set ID: 201141_at
agaggcgggatactttcagctttcc

SEQ ID NO: 668 - DNA, 25 bp, Artificial sequence
  Affy probe set ID: 201141_at
aagccaatgtagtccagtttctaag

SEQ ID NO: 669 - DNA, 25 bp, Artificial sequence
  Affy probe set ID: 201141_at
gttccaagctaactgaatcccactt

SEQ ID NO: 670 - DNA, 25 bp, Artificial sequence
  Affy probe set ID: 201141_at
tgaatcccacttcaatacacactca

SEQ ID NO: 671 - DNA, 25 bp, Artificial sequence
  Affy probe set ID: 201141_at
tacacactcatgaactcctgatgga

SEQ ID NO: 672 - DNA, 25 bp, Artificial sequence
  Affy probe set ID: 201141_at
caggcccaagcctgtggtatgatgt

SEQ ID NO: 673 - DNA, 25 bp, Artificial sequence
  Affy probe set ID: 201141_at
gatgtgcacacttgctagactcaga

SEQ ID NO: 674 - DNA, 25 bp, Artificial sequence
  Affy probe set ID: 201141_at
tgacaacctactttgcttggctgag

SEQ ID NO: 675 - DNA, 25 bp, Artificial sequence
  Affy probe set ID: 201141_at
tgtatagtcgctgcacatatttgaa

SEQ ID NO: 676 - DNA, 25 bp, Artificial sequence
  Affy probe set ID: 201141_at
agatgaggtccctggtttttcatgg

SEQ ID NO: 677 - DNA, 25 bp, Artificial sequence
  Affy probe set ID: 201141_at
aggatttcacctctgtttgtaacta

SEQ ID NO: 678 - DNA, 134 bp, Artificial sequence
  Target_Sequence, Fragment of GenBank Accession No. NM_002294
agtattctacagctcaagactgcagtgcagatgacgacaacttccttgtgcccatagcggtgggagctgccttggcaggagtacttattctagtgttgctggcttattttattggtctcaagcaccatcatgct

SEQ ID NO: 679 - DNA, 25 bp, Artificial sequence
  Affy probe set ID: 203041_s_at
agtattctacagctcaagactgcag

SEQ ID NO: 680 - DNA, 25 bp, Artificial sequence
  Affy probe set ID: 203041_s_at
gactgcagtgcagatgacgacaact

SEQ ID NO: 681 - DNA, 25 bp, Artificial sequence
  Affy probe set ID: 203041_s_at
gcagtgcagatgacgacaacttcct

SEQ ID NO: 682 - DNA, 25 bp, Artificial sequence
  Affy probe set ID: 203041_s_at
gtgcagatgacgacaacttccttgt

SEQ ID NO: 683 - DNA, 25 bp, Artificial sequence
  Affy probe set ID: 203041_s_at
cagatgacgacaacttccttgtgcc

SEQ ID NO: 684 - DNA, 25 bp, Artificial sequence
  Affy probe set ID: 203041_s_at
cttccttgtgcccatagcggtggga

SEQ ID NO: 685 - DNA, 25 bp, Artificial sequence
  Affy probe set ID: 203041_s_at
tgtgcccatagcggtgggagctgcc

SEQ ID NO: 686 - DNA, 25 bp, Artificial sequence
  Affy probe set ID: 203041_s_at
gctgccttggcaggagtacttattc

SEQ ID NO: 687 - DNA, 25 bp, Artificial sequence
  Affy probe set ID: 203041_s_at
ggcaggagtacttattctagtgttg

SEQ ID NO: 688 - DNA, 25 bp, Artificial sequence
  Affy probe set ID: 203041_s_at
tctagtgttgctggcttattttatt

SEQ ID NO: 689 - DNA, 25 bp, Artificial sequence
  Affy probe set ID: 203041_s_at
tattggtctcaagcaccatcatgct

SEQ ID NO: 690 - DNA, 534 bp, Artificial sequence
  Target_Sequence, Fragment of GenBank Accession No. NM_002888
  misc_feature (53)..(55): n is a, c, g, or t
  misc_feature (114)..(114): n is a, c, g, or t
  misc_feature (292)..(292): n is a, c, g, or t
atgatctttttccgacttctaaacaagtgactatactagcataaatcattctnnnagtaaaacagctaaggtatagacattctaataatttgggaaaacctatgattacaagtnaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcancattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttt

SEQ ID NO: 691 - DNA, 25 bp, Artificial sequence
  Affy probe set ID: 221872_at
atgatctttttccgacttctaaaca

SEQ ID NO: 692 - DNA, 25 bp, Artificial sequence
  Affy probe set ID: 221872_at
gtttctcagtctgctttagctttta

SEQ ID NO: 693 - DNA, 25 bp, Artificial sequence
  Affy probe set ID: 221872_at
aactctggaagcgcatgcacactga

SEQ ID NO: 694 - DNA, 25 bp, Artificial sequence
  Affy probe set ID: 221872_at
gcatgcacactgaactctgctcagt

SEQ ID NO: 695 - DNA, 25 bp, Artificial sequence
  Affy probe set ID: 221872_at
gaactctgctcagtgctaaacagtc

SEQ ID NO: 696 - DNA, 25 bp, Artificial sequence
  Affy probe set ID: 221872_at
ttcctcagggtttcagccctaaaat

SEQ ID NO: 697 - DNA, 25 bp, Artificial sequence
  Affy probe set ID: 221872_at
ggataatcagtgtatgttgcaccag

SEQ ID NO: 698 - DNA, 25 bp, Artificial sequence
  Affy probe set ID: 221872_at
tgatggtctcatctctgaatttata

SEQ ID NO: 699 - DNA, 25 bp, Artificial sequence
  Affy probe set ID: 221872_at
tatttctcattcttttgaacatact

SEQ ID NO: 700 - DNA, 25 bp, Artificial sequence
  Affy probe set ID: 221872_at
gatttcaggcaagtattcattttta

SEQ ID NO: 701 - DNA, 25 bp, Artificial sequence
  Affy probe set ID: 221872_at
tcatttttaacttgctacctacttt

SEQ ID NO: 702 - DNA, 145 bp, Artificial sequence
  Target_Sequence, Fragment of GenBank Accession No. NM_172248
tcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgat

SEQ ID NO: 703 - DNA, 25 bp, Artificial sequence
  Affy probe set ID: 210340_s_at
tcatctgggaggaattcaccccaga

SEQ ID NO: 704 - DNA, 25 bp, Artificial sequence
  Affy probe set ID: 210340_s_at
ctgggaggaattcaccccagaggaa

SEQ ID NO: 705 - DNA, 25 bp, Artificial sequence
  Affy probe set ID: 210340_s_at
gggaaaggctaccgcgaagaggtct

SEQ ID NO: 706 - DNA, 25 bp, Artificial sequence
  Affy probe set ID: 210340_s_at
aggctaccgcgaagaggtcttgacc

SEQ ID NO: 707 - DNA, 25 bp, Artificial sequence
  Affy probe set ID: 210340_s_at
ctaccgcgaagaggtcttgaccgtg

SEQ ID NO: 708 - DNA, 25 bp, Artificial sequence
  Affy probe set ID: 210340_s_at
agaggtcttgaccgtgaaggaaatt

SEQ ID NO: 709 - DNA, 25 bp, Artificial sequence
  Affy probe set ID: 210340_s_at
gaaggaaattacctgagacccagag

SEQ ID NO: 710 - DNA, 25 bp, Artificial sequence
  Affy probe set ID: 210340_s_at
aaattacctgagacccagagggtgt

SEQ ID NO: 711 - DNA, 25 bp, Artificial sequence
  Affy probe set ID: 210340_s_at
cagagggtgtaggaatggcatggac

SEQ ID NO: 712 - DNA, 25 bp, Artificial sequence
  Affy probe set ID: 210340_s_at
gcgacacgggggaactgttttcttg

SEQ ID NO: 713 - DNA, 25 bp, Artificial sequence
  Affy probe set ID: 210340_s_at
gacacgggggaactgttttcttgat

SEQ ID NO: 714 - DNA, 457 bp, Artificial sequence
  Target_Sequence, Fragment of GenBank Accession No. NM_018344
caaatcaggggtactcccttcacagctgatggttaacattccaccttctttctagcccttcaaagatgctgccagtgttcgccctagagttattacaaagccagtgccaaaacccagccatgggctctttgcaacctcccagctgcgctcattccagctgacagcgagatgcaagcaaatgctcagctctccttaccctgaaggggtctccctggaatggaagtcccctggcatggtcagtcctcaggcccaaggctcaagtgtgcacagacccctgtgttctgtgggtgaacaactgcccactaaccagactggaaaacccagaaagatgggccttccatgaatgcttcatcccagagggaccagagggcctccctgtgcaagggatcaagcatgtctggcctgggttttcaaaaaaagagggatcctcatgacctggtggtctatggcctgggtc

SEQ ID NO: 715 - DNA, 25 bp, Artificial sequence
  Affy probe set ID: 219344_at
caaatcaggggtactcccttcacag

SEQ ID NO: 716 - DNA, 25 bp, Artificial sequence
  Affy probe set ID: 219344_at
gctgatggttaacattccaccttct

SEQ ID NO: 717 - DNA, 25 bp, Artificial sequence
  Affy probe set ID: 219344_at
ctagcccttcaaagatgctgccagt

SEQ ID NO: 718 - DNA, 25 bp, Artificial sequence
  Affy probe set ID: 219344_at
ccagtgttcgccctagagttattac

SEQ ID NO: 719 - DNA, 25 bp, Artificial sequence
  Affy probe set ID: 219344_at
tgcaagcaaatgctcagctctcctt

SEQ ID NO: 720 - DNA, 25 bp, Artificial sequence
  Affy probe set ID: 219344_at
agctctccttaccctgaaggggtct

SEQ ID NO: 721 - DNA, 25 bp, Artificial sequence
  Affy probe set ID: 219344_at
gcccaaggctcaagtgtgcacagac

SEQ ID NO: 722 - DNA, 25 bp, Artificial sequence
  Affy probe set ID: 219344_at
agacccctgtgttctgtgggtgaac

SEQ ID NO: 723 - DNA, 25 bp, Artificial sequence
  Affy probe set ID: 219344_at
aactgcccactaaccagactggaaa

SEQ ID NO: 724 - DNA, 25 bp, Artificial sequence
  Affy probe set ID: 219344_at
aagggatcaagcatgtctggcctgg

SEQ ID NO: 725 - DNA, 25 bp, Artificial sequence
  Affy probe set ID: 219344_at
gacctggtggtctatggcctgggtc

SEQ ID NO: 726 - DNA, 465 bp, Artificial sequence
  Target_Sequence, Fragment of GenBank Accession No. NM_032413
gaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaagatttct

SEQ ID NO: 727 - DNA, 25 bp, Artificial sequence
  Affy probe set ID: 223484_at
gaaaaccgatgtgatccttgatcga

SEQ ID NO: 728 - DNA, 25 bp, Artificial sequence
  Affy probe set ID: 223484_at
tgggaaactgtggaccctactgtac

SEQ ID NO: 729 - DNA, 25 bp, Artificial sequence
  Affy probe set ID: 223484_at
accctactgtacctcaaaagcttat

SEQ ID NO: 730 - DNA, 25 bp, Artificial sequence
  Affy probe set ID: 223484_at
aagggtgaccaaatgacgagccctc

SEQ ID NO: 731 - DNA, 25 bp, Artificial sequence
  Affy probe set ID: 223484_at
acatttctgcacaaactagattctg

SEQ ID NO: 732 - DNA, 25 bp, Artificial sequence
  Affy probe set ID: 223484_at
agattctggacaccagtgtgcggaa

SEQ ID NO: 733 - DNA, 25 bp, Artificial sequence
  Affy probe set ID: 223484_at
gtgtgcggaaatgcttctgctacat

SEQ ID NO: 734 - DNA, 25 bp, Artificial sequence
  Affy probe set ID: 223484_at
tctgctacatttttagggtttgtct

SEQ ID NO: 735 - DNA, 25 bp, Artificial sequence
  Affy probe set ID: 223484_at
gtttgtctacattttttgggctctg

SEQ ID NO: 736 - DNA, 25 bp, Artificial sequence
  Affy probe set ID: 223484_at
agtttgtgcttattttcttgtaaat

SEQ ID NO: 737 - DNA, 25 bp, Artificial sequence
  Affy probe set ID: 223484_at
aaaatgccatttgtgcaagatttct

SEQ ID NO: 738 - DNA, 523 bp, Artificial sequence
  Target_Sequence, Fragment of GenBank Accession No. NM_001001851
  misc_feature (215)..(215): n is a, c, g, or t
  misc_feature (224)..(224): n is a, c, g, or t
  misc_feature (282)..(282): n is a, c, g, or t
  misc_feature (464)..(464): n is a, c, g, or t
actgggaatcggagtgggcacctctgtgtttctctagggagtaacattcaacatttaattgaatcgtgtatcctgataggtggattaggaacaggattcattcctttaactttaacttttggctaaacgacatgccttggattgagtgtatatgtcttccccaaattcatatgttgaagcttaaatcctgaatgtgatggttcttggaattgggnacctttggnaaggttattaggtcttgagggcagagccctcacgaatgggattaaggcccttataagnagagacatggggccaggtgcagtggctcacacctgtaatcccaacattttgggaggccgagaagggtggatcatgaggtcaggagatggagaccatcctggccaacatggtgaaacctcatctctactaaaaatacaaaaattagctgggcgtggtggtgcgtgcctgtagttccagctacntgggaggctgaggcaggagaatcgcttgaaccaggcagtcggaacttgtagtgagccaa

SEQ ID NO: 739 - DNA, 25 bp, Artificial sequence
  Affy probe set ID: 1553243_at
actgggaatcggagtgggcacctct

SEQ ID NO: 740 - DNA, 25 bp, Artificial sequence
  Affy probe set ID: 1553243_at
ggcacctctgtgtttctctagggag

SEQ ID NO: 741 - DNA, 25 bp, Artificial sequence
  Affy probe set ID: 1553243_at
ctctagggagtaacattcaacattt

SEQ ID NO: 742 - DNA, 25 bp, Artificial sequence
  Affy probe set ID: 1553243_at
aattgaatcgtgtatcctgataggt

SEQ ID NO: 743 - DNA, 25 bp, Artificial sequence
  Affy probe set ID: 1553243_at
tttaacttttggctaaacgacatgc

SEQ ID NO: 744 - DNA, 25 bp, Artificial sequence
  Affy probe set ID: 1553243_at
aaacgacatgccttggattgagtgt

SEQ ID NO: 745 - DNA, 25 bp, Artificial sequence
  Affy probe set ID: 1553243_at
gattgagtgtatatgtcttccccaa

SEQ ID NO: 746 - DNA, 25 bp, Artificial sequence
  Affy probe set ID: 1553243_at
gttgaagcttaaatcctgaatgtga

SEQ ID NO: 747 - DNA, 25 bp, Artificial sequence
  Affy probe set ID: 1553243_at
aaggttattaggtcttgagggcaga

SEQ ID NO: 748 - DNA, 25 bp, Artificial sequence
  Affy probe set ID: 1553243_at
tcgcttgaaccaggcagtcggaact

SEQ ID NO: 749 - DNA, 25 bp, Artificial sequence
  Affy probe set ID: 1553243_at
gcagtcggaacttgtagtgagccaa

SEQ ID NO: 750 - DNA, 515 bp, Artificial sequence
  Target_Sequence, Fragment of GenBank Accession No. NM_000211
gctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgag

SEQ ID NO: 751 - DNA, 25 bp, Artificial sequence
  Affy probe set ID: 1555349_a_at
gctgcaacgtatgcgagtgccattc

SEQ ID NO: 752 - DNA, 25 bp, Artificial sequence
  Affy probe set ID: 1555349_a_at
gagtgccattcaggctaccagctgc

SEQ ID NO: 753 - DNA, 25 bp, Artificial sequence
  Affy probe set ID: 1555349_a_at
tggcaagtacatctcctgcgccgag

SEQ ID NO: 754 - DNA, 25 bp, Artificial sequence
  Affy probe set ID: 1555349_a_at
tgcgccgagtgcctgaagttcgaaa

SEQ ID NO: 755 - DNA, 25 bp, Artificial sequence
  Affy probe set ID: 1555349_a_at
cctttgggaagaactgcagcgcggc

SEQ ID NO: 756 - DNA, 25 bp, Artificial sequence
  Affy probe set ID: 1555349_a_at
agctgtcgaacaaccccgtgaaggg

SEQ ID NO: 757 - DNA, 25 bp, Artificial sequence
  Affy probe set ID: 1555349_a_at
agcaggacgggatggaccgctacct

SEQ ID NO: 758 - DNA, 25 bp, Artificial sequence
  Affy probe set ID: 1555349_a_at
ggaccgctacctcatctatgtggat

SEQ ID NO: 759 - DNA, 25 bp, Artificial sequence
  Affy probe set ID: 1555349_a_at
gcaggcatcgtgctgatcggcattc

SEQ ID NO: 760 - DNA, 25 bp, Artificial sequence
  Affy probe set ID: 1555349_a_at
gctggtcatctggaaggctctgatc

SEQ ID NO: 761 - DNA, 25 bp, Artificial sequence
  Affy probe set ID: 1555349_a_at
ggtcatgaaccccaagtttgctgag

SEQ ID NO: 762 - DNA, 364 bp, Artificial sequence
  Target_Sequence, Fragment of GenBank Accession No. NM_005213
gccaaaatgatacctggaggcttatctgaggccaaacccgccactccagaaatccaggagattgttgataaggttaaaccacagcttgaagaaaaaacaaatgagacttatggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctga

SEQ ID NO: 763 - DNA, 25 bp, Artificial sequence
  Affy probe set ID: 204971_at
gccaaaatgatacctggaggcttat

SEQ ID NO: 764 - DNA, 25 bp, Artificial sequence
  Affy probe set ID: 204971_at
gaggcttatctgaggccaaacccgc

SEQ ID NO: 765 - DNA, 25 bp, Artificial sequence
  Affy probe set ID: 204971_at
acccgccactccagaaatccaggag

SEQ ID NO: 766 - DNA, 25 bp, Artificial sequence
  Affy probe set ID: 204971_at
gaagctgtgcagtataaaactcaag

SEQ ID NO: 767 - DNA, 25 bp, Artificial sequence
  Affy probe set ID: 204971_at
ttcaaaagtcttcccggacaaaatg

SEQ ID NO: 768 - DNA, 25 bp, Artificial sequence
  Affy probe set ID: 204971_at
tgaggacttggtacttactggatac

SEQ ID NO: 769 - DNA, 25 bp, Artificial sequence
  Affy probe set ID: 204971_at
gatgacgagctgacgggcttttagc

SEQ ID NO: 770 - DNA, 25 bp, Artificial sequence
  Affy probe set ID: 204971_at
cgggcttttagcagcatgtacccaa

SEQ ID NO: 771 - DNA, 25 bp, Artificial sequence
  Affy probe set ID: 204971_at
gtacccaaagtgttctgattccttc

SEQ ID NO: 772 - DNA, 25 bp, Artificial sequence
  Affy probe set ID: 204971_at
gattccttcaactggctactgagtc

SEQ ID NO: 773 - DNA, 25 bp, Artificial sequence
  Affy probe set ID: 204971_at
gctactgagtcatgatccttgctga

SEQ ID NO: 774 - DNA, 272 bp, Artificial sequence
  Target_Sequence, Fragment of GenBank Accession No. NM_003874
agatgcaccatgcatgctcacagtcccttgcctatgtgtggcagagtgtcccagccagatgtgtgcccccaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtac

SEQ ID NO: 775 - DNA, 25 bp, Artificial sequence
  Affy probe set ID: 205988_at
agatgcaccatgcatgctcacagtc

SEQ ID NO: 776 - DNA, 25 bp, Artificial sequence
  Affy probe set ID: 205988_at
cacagtcccttgcctatgtgtggca

SEQ ID NO: 777 - DNA, 25 bp, Artificial sequence
  Affy probe set ID: 205988_at
ctatgtgtggcagagtgtcccagcc

SEQ ID NO: 778 - DNA, 25 bp, Artificial sequence
  Affy probe set ID: 205988_at
cccaccccatgtccatttacatgtc

SEQ ID NO: 779 - DNA, 25 bp, Artificial sequence
  Affy probe set ID: 205988_at
aatgcccacctcaaaaggtacctct

SEQ ID NO: 780 - DNA, 25 bp, Artificial sequence
  Affy probe set ID: 205988_at
caaaaggtacctcttctgtaaagct

SEQ ID NO: 781 - DNA, 25 bp, Artificial sequence
  Affy probe set ID: 205988_at
ttctgtaaagctttccctggtatca

SEQ ID NO: 782 - DNA, 25 bp, Artificial sequence
  Affy probe set ID: 205988_at
atcagggatcttttcacactgctgt

SEQ ID NO: 783 - DNA, 25 bp, Artificial sequence
  Affy probe set ID: 205988_at
tttggtccttctatcactaaaactc

SEQ ID NO: 784 - DNA, 25 bp, Artificial sequence
  Affy probe set ID: 205988_at
ctcatctcattcagccttacagcat

SEQ ID NO: 785 - DNA, 25 bp, Artificial sequence
  Affy probe set ID: 205988_at
atttgttttcctcactacattgtac

SEQ ID NO: 786 - DNA, 422 bp, Artificial sequence
  Target_Sequence, Fragment of GenBank Accession No. NM_000228
gaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacacgttccagcccgttgccccactcatctgcgcgctttgcttttggttggggggcagattgggttggaatgctttccatctccaggagactttcatgtagcccaaagtacagcctggaccacccctggtgtgtgtagctagtaagattaccctgagctgcagctg

SEQ ID NO: 787 - DNA, 25 bp, Artificial sequence
  Affy probe set ID: 209270_at
gaccggttgggtcagagttccatgc

SEQ ID NO: 788 - DNA, 25 bp, Artificial sequence
  Affy probe set ID: 209270_at
ggtgcccggatccagagtgtgaaga

SEQ ID NO: 789 - DNA, 25 bp, Artificial sequence
  Affy probe set ID: 209270_at
agacatggagttggagctgctgcgg

SEQ ID NO: 790 - DNA, 25 bp, Artificial sequence
  Affy probe set ID: 209270_at
cgctcagcggacctgacaggactgg

SEQ ID NO: 791 - DNA, 25 bp, Artificial sequence
  Affy probe set ID: 209270_at
gaagcgtgtggagcagatccgtgac

SEQ ID NO: 792 - DNA, 25 bp, Artificial sequence
  Affy probe set ID: 209270_at
gatccgtgaccacatcaatgggcgc

SEQ ID NO: 793 - DNA, 25 bp, Artificial sequence
  Affy probe set ID: 209270_at
gcaagtgatgctacacgttccagcc

SEQ ID NO: 794 - DNA, 25 bp, Artificial sequence
  Affy probe set ID: 209270_at
aatgctttccatctccaggagactt

SEQ ID NO: 795 - DNA, 25 bp, Artificial sequence
  Affy probe set ID: 209270_at
gtagcccaaagtacagcctggacca

SEQ ID NO: 796 - DNA, 25 bp, Artificial sequence
  Affy probe set ID: 209270_at
accacccctggtgtgtgtagctagt

SEQ ID NO: 797 - DNA, 25 bp, Artificial sequence
  Affy probe set ID: 209270_at
gtaagattaccctgagctgcagctg

SEQ ID NO: 798 - DNA, 401 bp, Artificial sequence
  Target_Sequence, Fragment of GenBank Accession No. NM_005651
attccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaatcagtttcccctgagacttaatgtaaccacttaatgtaatcactatctcattgtttcatc

SEQ ID NO: 799 - DNA, 25 bp, Artificial sequence
  Affy probe set ID: 205943_at
attccccgacactggataccgaaga

SEQ ID NO: 800 - DNA, 25 bp, Artificial sequence
  Affy probe set ID: 205943_at
ggataccgaagatgaacccaaccat

SEQ ID NO: 801 - DNA, 25 bp, Artificial sequence
  Affy probe set ID: 205943_at
aacccaaccattcacaaatttctat

SEQ ID NO: 802 - DNA, 25 bp, Artificial sequence
  Affy probe set ID: 205943_at
gcagaatactgtgatagctcctact

SEQ ID NO: 803 - DNA, 25 bp, Artificial sequence
  Affy probe set ID: 205943_at
gatagctcctacttcagcagtgatg

SEQ ID NO: 804 - DNA, 25 bp, Artificial sequence
  Affy probe set ID: 205943_at
actggtttcacagcctattttttat

SEQ ID NO: 805 - DNA, 25 bp, Artificial sequence
  Affy probe set ID: 205943_at
tattgttcagcaccacgatgctctg

SEQ ID NO: 806 - DNA, 25 bp, Artificial sequence
  Affy probe set ID: 205943_at
gcaccacgatgctctgatttaattc

SEQ ID NO: 807 - DNA, 25 bp, Artificial sequence
  Affy probe set ID: 205943_at
atttgattacctcttgtttgtgaca

SEQ ID NO: 808 - DNA, 25 bp, Artificial sequence
  Affy probe set ID: 205943_at
tttcccctgagacttaatgtaacca

SEQ ID NO: 809 - DNA, 25 bp, Artificial sequence
  Affy probe set ID: 205943_at
gtaatcactatctcattgtttcatc

SEQ ID NO: 810 - DNA, 370 bp, Artificial sequence
  Target_Sequence, Fragment of GenBank Accession No. NM_001005266
  misc_feature (97)..(100): n is a, c, g, or t
  misc_feature (102)..(102): n is a, c, g, or t
  misc_feature (104)..(104): n is a, c, g, or t
  misc_feature (107)..(108): n is a, c, g, or t
  misc_feature (110)..(112): n is a, c, g, or t
  misc_feature (163)..(163): n is a, c, g, or t
  misc_feature (166)..(166): n is a, c, g, or t
gagacagagtcccactctgtcacccaggctggagtgcagtggtgcaatcttggctcactgcaacctccacctcccaggttcaagcgattctcgtgtnnnngncnccnnannngctgggactacaggtgcgccatgacgcctggctaatttttttgtattttcngtngagacggggtttcaccatgttggccagtctgctttcctcctaacctcaagtgagccgcctgcctcgaagatgctttatttataagcgctttggacacactttaataaatgctctattgtatacagttgaactctatataacattttgaataatattgttaatgcttaccctaagtactactatcatctctgtattgtttaacaa

SEQ ID NO: 811 - DNA, 25 bp, Artificial sequence
  Affy probe set ID: 242649_x_at
gagacagagtcccactctgtcaccc

SEQ ID NO: 812 - DNA, 25 bp, Artificial sequence
  Affy probe set ID: 242649_x_at
tttcctcctaacctcaagtgagccg

SEQ ID NO: 813 - DNA, 25 bp, Artificial sequence
  Affy probe set ID: 242649_x_at
gcctgcctcgaagatgctttattta

SEQ ID NO: 814 - DNA, 25 bp, Artificial sequence
  Affy probe set ID: 242649_x_at
ataagcgctttggacacactttaat

SEQ ID NO: 815 - DNA, 25 bp, Artificial sequence
  Affy probe set ID: 242649_x_at
gacacactttaataaatgctctatt

SEQ ID NO: 816 - DNA, 25 bp, Artificial sequence
  Affy probe set ID: 242649_x_at
gctctattgtatacagttgaactct

SEQ ID NO: 817 - DNA, 25 bp, Artificial sequence
  Affy probe set ID: 242649_x_at
gaactctatataacattttgaataa

SEQ ID NO: 818 - DNA, 25 bp, Artificial sequence
  Affy probe set ID: 242649_x_at
aatattgttaatgcttaccctaagt

SEQ ID NO: 819 - DNA, 25 bp, Artificial sequence
  Affy probe set ID: 242649_x_at
gcttaccctaagtactactatcatc

SEQ ID NO: 820 - DNA, 25 bp, Artificial sequence
  Affy probe set ID: 242649_x_at
aagtactactatcatctctgtattg

SEQ ID NO: 821 - DNA, 25 bp, Artificial sequence
  Affy probe set ID: 242649_x_at
ctatcatctctgtattgtttaacaa

SEQ ID NO: 822 - DNA, 483 bp, Artificial sequence
  Target_Sequence, Fragment of GenBank Accession No. AV659177
tcagactgaatatccctcttgtgcggccttctaaaacctcccgtccaaagcgaaatatattgccctctatttatacttttacagcatttggcacacaagtacagagtagtagctttttatcacattctctgataattatatagatatggtatttcttagctctctctccaactggctaataagttgctttttgtctgagtgcctaattttgtgttttgtgtctgagtgcctcagttcctcaaaaaaaggttttttgattagttcattattcatttgaacatggaaattatgctcactagtggcaaatgccactaaccgtattccagaagctaggtgtcatgtttgcaataagatatattatcccttctacaagtcaccttttatttcaggcatttgtaaatgcccattaataaagtatggttcataaattttaccttgtaagtgcctaagaaatgagactacaagctccatttcagcaggaca

SEQ ID NO: 823 - DNA, 25 bp, Artificial sequence
  Affy probe set ID: 230391_at
tcagactgaatatccctcttgtgcg

SEQ ID NO: 824 - DNA, 25 bp, Artificial sequence
  Affy probe set ID: 230391_at
acctcccgtccaaagcgaaatatat

SEQ ID NO: 825 - DNA, 25 bp, Artificial sequence
  Affy probe set ID: 230391_at
tgccctctatttatacttttacagc

SEQ ID NO: 826 - DNA, 25 bp, Artificial sequence
  Affy probe set ID: 230391_at
atatggtatttcttagctctctctc

SEQ ID NO: 827 - DNA, 25 bp, Artificial sequence
  Affy probe set ID: 230391_at
gctctctctccaactggctaataag

SEQ ID NO: 828 - DNA, 25 bp, Artificial sequence
  Affy probe set ID: 230391_at
tgtctgagtgcctaattttgtgttt

SEQ ID NO: 829 - DNA, 25 bp, Artificial sequence
  Affy probe set ID: 230391_at
tgtgtctgagtgcctcagttcctca

SEQ ID NO: 830 - DNA, 25 bp, Artificial sequence
  Affy probe set ID: 230391_at
atgccactaaccgtattccagaagc

SEQ ID NO: 831 - DNA, 25 bp, Artificial sequence
  Affy probe set ID: 230391_at
gaagctaggtgtcatgtttgcaata

SEQ ID NO: 832 - DNA, 25 bp, Artificial sequence
  Affy probe set ID: 230391_at
atcccttctacaagtcaccttttat

SEQ ID NO: 833 - DNA, 25 bp, Artificial sequence
  Affy probe set ID: 230391_at
ctacaagctccatttcagcaggaca

SEQ ID NO: 834 - DNA, 299 bp, Artificial sequence
  Target_Sequence, Fragment of GenBank Accession No. NM_001747
tggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccctttgcccttgaactgctgatatctgatgactgctttgtgctggacaacgggctctgtggcaagatctat

SEQ ID NO: 835 - DNA, 25 bp, Artificial sequence
  Affy probe set ID: 201850_at
tggccatccgggacagtgagcgaca

SEQ ID NO: 836 - DNA, 25 bp, Artificial sequence
  Affy probe set ID: 201850_at
gagcgacagggcaaggcccaggtgg

SEQ ID NO: 837 - DNA, 25 bp, Artificial sequence
  Affy probe set ID: 201850_at
tgctgagatgatccaggtcctgggc

SEQ ID NO: 838 - DNA, 25 bp, Artificial sequence
  Affy probe set ID: 201850_at
ggagggcaaccctgaggaagacctc

SEQ ID NO: 839 - DNA, 25 bp, Artificial sequence
  Affy probe set ID: 201850_at
tgacaaggcaaatgcccaggccgca

SEQ ID NO: 840 - DNA, 25 bp, Artificial sequence
  Affy probe set ID: 201850_at
aggccgcagctctgtataaggtctc

SEQ ID NO: 841 - DNA, 25 bp, Artificial sequence
  Affy probe set ID: 201850_at
taaggtctctgatgccactggacag

SEQ ID NO: 842 - DNA, 25 bp, Artificial sequence
  Affy probe set ID: 201850_at
gatgaacctgaccaaggtggctgac

SEQ ID NO: 843 - DNA, 25 bp, Artificial sequence
  Affy probe set ID: 201850_at
cctttgcccttgaactgctgatatc

SEQ ID NO: 844 - DNA, 25 bp, Artificial sequence
  Affy probe set ID: 201850_at
gactgctttgtgctggacaacgggc

SEQ ID NO: 845 - DNA, 25 bp, Artificial sequence
  Affy probe set ID: 201850_at
caacgggctctgtggcaagatctat

SEQ ID NO: 846 - DNA, 554 bp, Artificial sequence
  Target_Sequence, Fragment of GenBank Accession No. NM_000784
gtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaa

SEQ ID NO: 847 - DNA, 25 bp, Artificial sequence
  Affy probe set ID: 203979_at
gtgttctgccactatgtggtgtccc

SEQ ID NO: 848 - DNA, 25 bp, Artificial sequence
  Affy probe set ID: 203979_at
tctctgagcctgaaagcttccagcc

SEQ ID NO: 849 - DNA, 25 bp, Artificial sequence
  Affy probe set ID: 203979_at
tgccctttggctatggggtccgggc

SEQ ID NO: 850 - DNA, 25 bp, Artificial sequence
  Affy probe set ID: 203979_at
gcctgggccgcaggattgcagagct

SEQ ID NO: 851 - DNA, 25 bp, Artificial sequence
  Affy probe set ID: 203979_at
ttgaagagtgtggcccgcattgtcc

SEQ ID NO: 852 - DNA, 25 bp, Artificial sequence
  Affy probe set ID: 203979_at
gcattgtcctggttcccaataagaa

SEQ ID NO: 853 - DNA, 25 bp, Artificial sequence
  Affy probe set ID: 203979_at
ccagctctggcacagtggttcctgg

SEQ ID NO: 854 - DNA, 25 bp, Artificial sequence
  Affy probe set ID: 203979_at
ggagagaaggaggccgccagactcg

SEQ ID NO: 855 - DNA, 25 bp, Artificial sequence
  Affy probe set ID: 203979_at
gaggtgggaggaactccttgcacac

SEQ ID NO: 856 - DNA, 25 bp, Artificial sequence
  Affy probe set ID: 203979_at
tcatttttgagcaactccctctcag

SEQ ID NO: 857 - DNA, 25 bp, Artificial sequence
  Affy probe set ID: 203979_at
atcgcattgctgtccttgggtagaa

SEQ ID NO: 858 - DNA, 357 bp, Artificial sequence
  Target_Sequence, Fragment of GenBank Accession No. NM_052998
ggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggt

SEQ ID NO: 859 - DNA, 25 bp, Artificial sequence
  Affy probe set ID: 228000_at
ggagggtgtgtgcaagcctctgtcc

SEQ ID NO: 860 - DNA, 25 bp, Artificial sequence
  Affy probe set ID: 228000_at
agatcacagacaccctgtgcgtggg

SEQ ID NO: 861 - DNA, 25 bp, Artificial sequence
  Affy probe set ID: 228000_at
ttcaccccagcgagcatcatgtgag

SEQ ID NO: 862 - DNA, 25 bp, Artificial sequence
  Affy probe set ID: 228000_at
agcatcatgtgagtgggcctcgttc

SEQ ID NO: 863 - DNA, 25 bp, Artificial sequence
  Affy probe set ID: 228000_at
ggggcctcagagatgcatctgggag

SEQ ID NO: 864 - DNA, 25 bp, Artificial sequence
  Affy probe set ID: 228000_at
ggcaggcaagggtacccttggccag

SEQ ID NO: 865 - DNA, 25 bp, Artificial sequence
  Affy probe set ID: 228000_at
gtgtttctgccctgtaaataggacc

SEQ ID NO: 866 - DNA, 25 bp, Artificial sequence
  Affy probe set ID: 228000_at
aataggaccagtcttacactcgctg

SEQ ID NO: 867 - DNA, 25 bp, Artificial sequence
  Affy probe set ID: 228000_at
acactcgctgtagttcaagtatgca

SEQ ID NO: 868 - DNA, 25 bp, Artificial sequence
  Affy probe set ID: 228000_at
tgcagtgcaaggggcctggtcagcc

SEQ ID NO: 869 - DNA, 25 bp, Artificial sequence
  Affy probe set ID: 228000_at
ggcctggtcagccaggtgtgggggt

SEQ ID NO: 870 - DNA, 536 bp, Artificial sequence
  Target_Sequence, Fragment of GenBank Accession No. NM_016240
tccccaagggggctcctttggagtggtagggaggatcaggctgcagaagggccaaccccttgcaacagggcagctctcgcctcccgcacacggctctcctgatcacagctgcatgccgaccttgtcccaccgggacccacaatggcccgagccctctttgcatgggcagccagctggactaggagtgggaagggcctggacactcacagaggccccctctgtcatcactccttggcacccaccaacttcctgcacacactggcagagaggggcgctgggaaatcaccccacagggtggaggtctcctgttggctacactctaaagctgctttgccttcatgttcaaacagattcaggcaccaccccctccaccgcccgcaaggttagggcatagatttgtctccttcccaacacggacccagagagcagcccttccctgctcaaagcctttccgcaccctcctgactgtcctggatgtgcaactggtttgcactgcacaccccacggccatgtaactctcctgtccacatatgata

SEQ ID NO: 871 - DNA, 25 bp, Artificial sequence
  Affy probe set ID: 219416_at
tccccaagggggctcctttggagtg

SEQ ID NO: 872 - DNA, 25 bp, Artificial sequence
  Affy probe set ID: 219416_at
caaccccttgcaacagggcagctct

SEQ ID NO: 873 - DNA, 25 bp, Artificial sequence
  Affy probe set ID: 219416_at
cctctttgcatgggcagccagctgg

SEQ ID NO: 874 - DNA, 25 bp, Artificial sequence
  Affy probe set ID: 219416_at
ggcagccagctggactaggagtggg

SEQ ID NO: 875 - DNA, 25 bp, Artificial sequence
  Affy probe set ID: 219416_at
cacactggcagagaggggcgctggg

SEQ ID NO: 876 - DNA, 25 bp, Artificial sequence
  Affy probe set ID: 219416_at
caccccacagggtggaggtctcctg

SEQ ID NO: 877 - DNA, 25 bp, Artificial sequence
  Affy probe set ID: 219416_at
tctcctgttggctacactctaaagc

SEQ ID NO: 878 - DNA, 25 bp, Artificial sequence
  Affy probe set ID: 219416_at
gctacactctaaagctgctttgcct

SEQ ID NO: 879 - DNA, 25 bp, Artificial sequence
  Affy probe set ID: 219416_at
agggcatagatttgtctccttccca

SEQ ID NO: 880 - DNA, 25 bp, Artificial sequence
  Affy probe set ID: 219416_at
actgtcctggatgtgcaactggttt

SEQ ID NO: 881 - DNA, 25 bp, Artificial sequence
  Affy probe set ID: 219416_at
gtaactctcctgtccacatatgata

SEQ ID NO: 882 - DNA, 157 bp, Artificial sequence
  Target_Sequence, Fragment of GenBank Accession No. Z74615
agggcctaagggtgacagaggtgatgctggtcccaaaggtgctgatggctctcctggcaaagatggcgtccgtggtctgaccggccccattggtcctcctggccctgctggtgcccctggtgacaagggggaccccattcccgaggagctttatgag

SEQ ID NO: 883 - DNA, 25 bp, Artificial sequence
  Affy probe set ID: 217430_x_at
agggcctaagggtgacagaggtgat

SEQ ID NO: 884 - DNA, 25 bp, Artificial sequence
  Affy probe set ID: 217430_x_at
gtgacagaggtgatgctggtcccaa

SEQ ID NO: 885 - DNA, 25 bp, Artificial sequence
  Affy probe set ID: 217430_x_at
gaggtgatgctggtcccaaaggtgc

SEQ ID NO: 886 - DNA, 25 bp, Artificial sequence
  Affy probe set ID: 217430_x_at
gatgctggtcccaaaggtgctgatg

SEQ ID NO: 887 - DNA, 25 bp, Artificial sequence
  Affy probe set ID: 217430_x_at
tcccaaaggtgctgatggctctcct

SEQ ID NO: 888 - DNA, 25 bp, Artificial sequence
  Affy probe set ID: 217430_x_at
tgatggctctcctggcaaagatggc

SEQ ID NO: 889 - DNA, 25 bp, Artificial sequence
  Affy probe set ID: 217430_x_at
tggctctcctggcaaagatggcgtc

SEQ ID NO: 890 - DNA, 25 bp, Artificial sequence
  Affy probe set ID: 217430_x_at
gcaaagatggcgtccgtggtctgac

SEQ ID NO: 891 - DNA, 25 bp, Artificial sequence
  Affy probe set ID: 217430_x_at
tgctggtgcccctggtgacaagggg

SEQ ID NO: 892 - DNA, 25 bp, Artificial sequence
  Affy probe set ID: 217430_x_at
tggtgcccctggtgacaagggggac

SEQ ID NO: 893 - DNA, 25 bp, Artificial sequence
  Affy probe set ID: 217430_x_at
ccccattcccgaggagctttatgag

SEQ ID NO: 894 - DNA, 422 bp, Artificial sequence
  Target_Sequence, Fragment of GenBank Accession No. NM_052947
gagagtgcgtggcaatccttactcccagccgactgtgcgccaagatgcttctaaacccatcacctgctgtcttcactcaaatgatttcagaacaggatttgcgaccaggtttatggggagattgaatcaacgattggtctcaaagacagtccattctttatatacacgtttagcatttttaccaacctcacatcatgtgtatatttgtgtatttgcacatggttgtgctgtcgaggacctggtgctgagaagagtctgttcacagccaaaattcttcccactgtcattcctaacctgggatttctagacacatcctgctgtgatgtaaacagaaatcacgaattcgctcactggatcaagttgttccactggtgtctaatacgctattgttgccggaggtgggttctgtgacgtgaagccat

SEQ ID NO: 895 - DNA, 25 bp, Artificial sequence
  Affy probe set ID: 228367_at
gagagtgcgtggcaatccttactcc

SEQ ID NO: 896 - DNA, 25 bp, Artificial sequence
  Affy probe set ID: 228367_at
aagatgcttctaaacccatcacctg

SEQ ID NO: 897 - DNA, 25 bp, Artificial sequence
  Affy probe set ID: 228367_at
acctgctgtcttcactcaaatgatt

SEQ ID NO: 898 - DNA, 25 bp, Artificial sequence
  Affy probe set ID: 228367_at
gacagtccattctttatatacacgt

SEQ ID NO: 899 - DNA, 25 bp, Artificial sequence
  Affy probe set ID: 228367_at
tttttaccaacctcacatcatgtgt

SEQ ID NO: 900 - DNA, 25 bp, Artificial sequence
  Affy probe set ID: 228367_at
atggttgtgctgtcgaggacctggt

SEQ ID NO: 901 - DNA, 25 bp, Artificial sequence
  Affy probe set ID: 228367_at
gggatttctagacacatcctgctgt

SEQ ID NO: 902 - DNA, 25 bp, Artificial sequence
  Affy probe set ID: 228367_at
tcacgaattcgctcactggatcaag

SEQ ID NO: 903 - DNA, 25 bp, Artificial sequence
  Affy probe set ID: 228367_at
ggatcaagttgttccactggtgtct

SEQ ID NO: 904 - DNA, 25 bp, Artificial sequence
  Affy probe set ID: 228367_at
aatacgctattgttgccggaggtgg

SEQ ID NO: 905 - DNA, 25 bp, Artificial sequence
  Affy probe set ID: 228367_at
ggtgggttctgtgacgtgaagccat

SEQ ID NO: 906 - DNA, 525 bp, Artificial sequence
  Target_Sequence, Fragment of GenBank Accession No. NM_021136
ttcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaac

SEQ ID NO: 907 - DNA, 25 bp, Artificial sequence
  Affy probe set ID: 210222_s_at
ttcaggctaaaatcccaggcgctaa

SEQ ID NO: 908 - DNA, 25 bp, Artificial sequence
  Affy probe set ID: 210222_s_at
tcccaggcgctaagaggcacgctga

SEQ ID NO: 909 - DNA, 25 bp, Artificial sequence
  Affy probe set ID: 210222_s_at
tgatttcccaccggggactggacac

SEQ ID NO: 910 - DNA, 25 bp, Artificial sequence
  Affy probe set ID: 210222_s_at
gtctggagtggtaacagctctcttc

SEQ ID NO: 911 - DNA, 25 bp, Artificial sequence
  Affy probe set ID: 210222_s_at
ttaggctgttccttgtactcttagg

SEQ ID NO: 912 - DNA, 25 bp, Artificial sequence
  Affy probe set ID: 210222_s_at
gagtcacttgtgtcaaccactaaag

SEQ ID NO: 913 - DNA, 25 bp, Artificial sequence
  Affy probe set ID: 210222_s_at
ggtgagagcccaagttatctttccc

SEQ ID NO: 914 - DNA, 25 bp, Artificial sequence
  Affy probe set ID: 210222_s_at
ttctcttctctgcaatgcttctgta

SEQ ID NO: 915 - DNA, 25 bp, Artificial sequence
  Affy probe set ID: 210222_s_at
tcctgccgagtgctctgatgcaata

SEQ ID NO: 916 - DNA, 25 bp, Artificial sequence
  Affy probe set ID: 210222_s_at
gaaatcgcttatatgtccttgggtt

SEQ ID NO: 917 - DNA, 25 bp, Artificial sequence
  Affy probe set ID: 210222_s_at
ttagcatttttccaacacacacaac

SEQ ID NO: 918 - DNA, 527 bp, Artificial sequence
  Target_Sequence, Fragment of GenBank Accession No. AL049370
  misc_feature (102)..(102): n is a, c, g, or t
  misc_feature (106)..(106): n is a, c, g, or t
tgcctatgcttttctctgtgggcacatcaggatgcccctcggagagcatgtgcacgtgtccccacctgagcgagcgtgtgtgtgtgctcctctgcgtcccangttnggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaac

SEQ ID NO: 919 - DNA, 25 bp, Artificial sequence
  Affy probe set ID: 213100_at
tgcctatgcttttctctgtgggcac

SEQ ID NO: 920 - DNA, 25 bp, Artificial sequence
  Affy probe set ID: 213100_at
tgtgggcacatcaggatgcccctcg

SEQ ID NO: 921 - DNA, 25 bp, Artificial sequence
  Affy probe set ID: 213100_at
ggacgtctagggtttggtgtgcctg

SEQ ID NO: 922 - DNA, 25 bp, Artificial sequence
  Affy probe set ID: 213100_at
agggtcagtcaatgtatcttctacg

SEQ ID NO: 923 - DNA, 25 bp, Artificial sequence
  Affy probe set ID: 213100_at
ccccggctccagagctcaggggtag

SEQ ID NO: 924 - DNA, 25 bp, Artificial sequence
  Affy probe set ID: 213100_at
ggggttctcctgagggtgcagggga

SEQ ID NO: 925 - DNA, 25 bp, Artificial sequence
  Affy probe set ID: 213100_at
gtcccttaggggaggtgaccaggag

SEQ ID NO: 926 - DNA, 25 bp, Artificial sequence
  Affy probe set ID: 213100_at
ctttggtgcagggagctcttggtgg

SEQ ID NO: 927 - DNA, 25 bp, Artificial sequence
  Affy probe set ID: 213100_at
ccctgccaggtctgtggacatggtt

SEQ ID NO: 928 - DNA, 25 bp, Artificial sequence
  Affy probe set ID: 213100_at
ggacatggttatatgcccgggagag

SEQ ID NO: 929 - DNA, 25 bp, Artificial sequence
  Affy probe set ID: 213100_at
taacctttagcattcctattgtaac

SEQ ID NO: 930 - DNA, 500 bp, Artificial sequence
  Target_Sequence, Fragment of GenBank Accession No. NM_006042
gactttggctgggatggataaccatataatttaaaaagaaaaaaaaaatcaaaatataatatatttttttaccaatcggtagagaagagacagtttaatatttgtgctgaaaatatgtttcagtatttttttcaatgaatgttaagagattgttctcactcccgccccatcttaatgtataaccaacaccaaacacgtggatcaacagaaaaggaaaatttcactcgtctaaacactttcaattttcagtttttattttatgttctatatacccagtcataaagtataagcatcagttgtcattaaaagttttcagaaaatcttgaggttaaacatctctctctctttttttaaaatacaaggccctgataaaattgatatctatccttatatttttctccctttttcccgtgccactttttcttaaattatttcccagttagtattatcatatgtttgtacccgtcacagttttcatagtgctttcaaatacacctttt

SEQ ID NO: 931 - DNA, 25 bp, Artificial sequence
  Affy probe set ID: 219985_at
gactttggctgggatggataaccat

SEQ ID NO: 932 - DNA, 25 bp, Artificial sequence
  Affy probe set ID: 219985_at
gttaagagattgttctcactcccgc

SEQ ID NO: 933 - DNA, 25 bp, Artificial sequence
  Affy probe set ID: 219985_at
cccgccccatcttaatgtataacca

SEQ ID NO: 934 - DNA, 25 bp, Artificial sequence
  Affy probe set ID: 219985_at
taaccaacaccaaacacgtggatca

SEQ ID NO: 935 - DNA, 25 bp, Artificial sequence
  Affy probe set ID: 219985_at
atttcactcgtctaaacactttcaa

SEQ ID NO: 936 - DNA, 25 bp, Artificial sequence
  Affy probe set ID: 219985_at
attttatgttctatatacccagtca

SEQ ID NO: 937 - DNA, 25 bp, Artificial sequence
  Affy probe set ID: 219985_at
aagtataagcatcagttgtcattaa

SEQ ID NO: 938 - DNA, 25 bp, Artificial sequence
  Affy probe set ID: 219985_at
tatttcccagttagtattatcatat

SEQ ID NO: 939 - DNA, 25 bp, Artificial sequence
  Affy probe set ID: 219985_at
attatcatatgtttgtacccgtcac

SEQ ID NO: 940 - DNA, 25 bp, Artificial sequence
  Affy probe set ID: 219985_at
gtacccgtcacagttttcatagtgc

SEQ ID NO: 941 - DNA, 25 bp, Artificial sequence
  Affy probe set ID: 219985_at
catagtgctttcaaatacacctttt

SEQ ID NO: 942 - DNA, 444 bp, Artificial sequence
  Target_Sequence, Fragment of GenBank Accession No. NM_000041
gaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcc

SEQ ID NO: 943 - DNA, 25 bp, Artificial sequence
  Affy probe set ID: 203382_s_at
gaagcgcctggcagtgtaccaggcc

SEQ ID NO: 944 - DNA, 25 bp, Artificial sequence
  Affy probe set ID: 203382_s_at
aagcgcctggcagtgtaccaggccg

SEQ ID NO: 945 - DNA, 25 bp, Artificial sequence
  Affy probe set ID: 203382_s_at
tggggcccctggtggaacagggccg

SEQ ID NO: 946 - DNA, 25 bp, Artificial sequence
  Affy probe set ID: 203382_s_at
ggcccctggtggaacagggccgcgt

SEQ ID NO: 947 - DNA, 25 bp, Artificial sequence
  Affy probe set ID: 203382_s_at
ccctggtggaacagggccgcgtgcg

SEQ ID NO: 948 - DNA, 25 bp, Artificial sequence
  Affy probe set ID: 203382_s_at
gcgcgcgcggatggaggagatgggc

SEQ ID NO: 949 - DNA, 25 bp, Artificial sequence
  Affy probe set ID: 203382_s_at
agcaggcccagcagatacgcctgca

SEQ ID NO: 950 - DNA, 25 bp, Artificial sequence
  Affy probe set ID: 203382_s_at
tggtggaagacatgcagcgccagtg

SEQ ID NO: 951 - DNA, 25 bp, Artificial sequence
  Affy probe set ID: 203382_s_at
gtgcccagcgacaatcactgaacgc

SEQ ID NO: 952 - DNA, 25 bp, Artificial sequence
  Affy probe set ID: 203382_s_at
gcccagcgacaatcactgaacgccg

SEQ ID NO: 953 - DNA, 25 bp, Artificial sequence
  Affy probe set ID: 203382_s_at
gcgacaatcactgaacgccgaagcc

SEQ ID NO: 954 - DNA, 341 bp, Artificial sequence
  Target_Sequence, Fragment of GenBank Accession No. NM_004994
ggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttgcagtgccatgtaaatccccactgggaccaaccctggggaaggagccagtttgccggatacaaa

SEQ ID NO: 955 - DNA, 25 bp, Artificial sequence
  Affy probe set ID: 203936_s_at
ggaagatgctgctgttcagcgggcg

SEQ ID NO: 956 - DNA, 25 bp, Artificial sequence
  Affy probe set ID: 203936_s_at
cgcctctggaggttcgacgtgaagg

SEQ ID NO: 957 - DNA, 25 bp, Artificial sequence
  Affy probe set ID: 203936_s_at
gtgaaggcgcagatggtggatcccc

SEQ ID NO: 958 - DNA, 25 bp, Artificial sequence
  Affy probe set ID: 203936_s_at
gacgtcttccagtaccgagagaaag

SEQ ID NO: 959 - DNA, 25 bp, Artificial sequence
  Affy probe set ID: 203936_s_at
ttctgccaggaccgcttctactggc

SEQ ID NO: 960 - DNA, 25 bp, Artificial sequence
  Affy probe set ID: 203936_s_at
cgcgtgagttcccggagtgagttga

SEQ ID NO: 961 - DNA, 25 bp, Artificial sequence
  Affy probe set ID: 203936_s_at
ggtggaccaagtgggctacgtgacc

SEQ ID NO: 962 - DNA, 25 bp, Artificial sequence
  Affy probe set ID: 203936_s_at
ctacgtgacctatgacatcctgcag

SEQ ID NO: 963 - DNA, 25 bp, Artificial sequence
  Affy probe set ID: 203936_s_at
catcctgcagtgccctgaggactag

SEQ ID NO: 964 - DNA, 25 bp, Artificial sequence
  Affy probe set ID: 203936_s_at
gccatgtaaatccccactgggacca

SEQ ID NO: 965 - DNA, 25 bp, Artificial sequence
  Affy probe set ID: 203936_s_at
aaggagccagtttgccggatacaaa

SEQ ID NO: 966 - DNA, 323 bp, Artificial sequence
  Target_Sequence, Fragment of GenBank Accession No. NM_001831
tcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaacta

SEQ ID NO: 967 - DNA, 25 bp, Artificial sequence
  Affy probe set ID: 222043_at
tcgactctgctgctcatgggaagaa

SEQ ID NO: 968 - DNA, 25 bp, Artificial sequence
  Affy probe set ID: 222043_at
acagaattgctcctgcatgcaacta

SEQ ID NO: 969 - DNA, 25 bp, Artificial sequence
  Affy probe set ID: 222043_at
tgtcttgtgagctgatcgcttggag

SEQ ID NO: 970 - DNA, 25 bp, Artificial sequence
  Affy probe set ID: 222043_at
tgagctgatcgcttggagggtcctc

SEQ ID NO: 971 - DNA, 25 bp, Artificial sequence
  Affy probe set ID: 222043_at
ggagggtcctctttttatgttgagt

SEQ ID NO: 972 - DNA, 25 bp, Artificial sequence
  Affy probe set ID: 222043_at
ctttttatgttgagttgctgcttcc

SEQ ID NO: 973 - DNA, 25 bp, Artificial sequence
  Affy probe set ID: 222043_at
cattttgctatggggggcaggcagg

SEQ ID NO: 974 - DNA, 25 bp, Artificial sequence
  Affy probe set ID: 222043_at
gtatagggactgtcataccagtgaa

SEQ ID NO: 975 - DNA, 25 bp, Artificial sequence
  Affy probe set ID: 222043_at
gatatgatgacaaggttgatccact

SEQ ID NO: 976 - DNA, 25 bp, Artificial sequence
  Affy probe set ID: 222043_at
gatccacttcaagaattgcttgctt

SEQ ID NO: 977 - DNA, 25 bp, Artificial sequence
  Affy probe set ID: 222043_at
gagatgtgtttcaacaagccaacta

SEQ ID NO: 978 - DNA, 398 bp, Artificial sequence
  Target_Sequence, Fragment of GenBank Accession No. NM_002305
ctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaa

SEQ ID NO: 979 - DNA, 25 bp, Artificial sequence
  Affy probe set ID: 201105_at
ctcctggactcaatcatggcttgtg

SEQ ID NO: 980 - DNA, 25 bp, Artificial sequence
  Affy probe set ID: 201105_at
atcatggcttgtggtctggtcgcca

SEQ ID NO: 981 - DNA, 25 bp, Artificial sequence
  Affy probe set ID: 201105_at
gtcgccagcaacctgaatctcaaac

SEQ ID NO: 982 - DNA, 25 bp, Artificial sequence
  Affy probe set ID: 201105_at
aaacctggagagtgccttcgagtgc

SEQ ID NO: 983 - DNA, 25 bp, Artificial sequence
  Affy probe set ID: 201105_at
gtgccttcgagtgcgaggcgaggtg

SEQ ID NO: 984 - DNA, 25 bp, Artificial sequence
  Affy probe set ID: 201105_at
ctcctgacgctaagagcttcgtgct

SEQ ID NO: 985 - DNA, 25 bp, Artificial sequence
  Affy probe set ID: 201105_at
gcttcgtgctgaacctgggcaaaga

SEQ ID NO: 986 - DNA, 25 bp, Artificial sequence
  Affy probe set ID: 201105_at
tgtgcaacagcaaggacggcggggc

SEQ ID NO: 987 - DNA, 25 bp, Artificial sequence
  Affy probe set ID: 201105_at
accgagcagcgggaggctgtctttc

SEQ ID NO: 988 - DNA, 25 bp, Artificial sequence
  Affy probe set ID: 201105_at
gaccgtcaagctgccagatggatac

SEQ ID NO: 989 - DNA, 25 bp, Artificial sequence
  Affy probe set ID: 201105_at
acatggcagctgacggtgacttcaa

SEQ ID NO: 990 - DNA, 524 bp, Artificial sequence
  Target_Sequence, Fragment of GenBank Accession No. NM_032024
gacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcac

SEQ ID NO: 991 - DNA, 25 bp, Artificial sequence
  Affy probe set ID: 223703_at
gacaacaatcagctgggggacgacc

SEQ ID NO: 992 - DNA, 25 bp, Artificial sequence
  Affy probe set ID: 223703_at
gacgaccttgtgttgccagggttac

SEQ ID NO: 993 - DNA, 25 bp, Artificial sequence
  Affy probe set ID: 223703_at
gcataccttaaccctcaacaagaac

SEQ ID NO: 994 - DNA, 25 bp, Artificial sequence
  Affy probe set ID: 223703_at
gtgacaccagctctggagtacctca

SEQ ID NO: 995 - DNA, 25 bp, Artificial sequence
  Affy probe set ID: 223703_at
gttctgtacaagctgcccaacttga

SEQ ID NO: 996 - DNA, 25 bp, Artificial sequence
  Affy probe set ID: 223703_at
ggaggcgttggtcagaggagtcttc

SEQ ID NO: 997 - DNA, 25 bp, Artificial sequence
  Affy probe set ID: 223703_at
ttctagtgaggacgttgccagctcc

SEQ ID NO: 998 - DNA, 25 bp, Artificial sequence
  Affy probe set ID: 223703_at
ggaactcaccagtcaccaaggtgtc

SEQ ID NO: 999 - DNA, 25 bp, Artificial sequence
  Affy probe set ID: 223703_at
tcctggggaagtgtcgctacgttta

SEQ ID NO: 1000 - DNA, 25 bp, Artificial sequence
  Affy probe set ID: 223703_at
gatgaccagctctgaagccaacttc

SEQ ID NO: 1001 - DNA, 25 bp, Artificial sequence
  Affy probe set ID: 223703_at
gaagccaacttctgtataccttcac

SEQ ID NO: 1002 - DNA, 486 bp, Artificial sequence
  Target_Sequence, Fragment of GenBank Accession No. NM_001025201
gctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagca

SEQ ID NO: 1003 - DNA, 25 bp, Artificial sequence
  Affy probe set ID: 212624_s_at
gctcctgtagctgcattatttcttg

SEQ ID NO: 1004 - DNA, 25 bp, Artificial sequence
  Affy probe set ID: 212624_s_at
caccgctcagctgtcttgtaaaaca

SEQ ID NO: 1005 - DNA, 25 bp, Artificial sequence
  Affy probe set ID: 212624_s_at
tttctggttctagtaatcctgggtg

SEQ ID NO: 1006 - DNA, 25 bp, Artificial sequence
  Affy probe set ID: 212624_s_at
atcctgggtgtttatcacgttcaga

SEQ ID NO: 1007 - DNA, 25 bp, Artificial sequence
  Affy probe set ID: 212624_s_at
gctattgcatgattagccccctatc

SEQ ID NO: 1008 - DNA, 25 bp, Artificial sequence
  Affy probe set ID: 212624_s_at
cctgggtagtctgtgcttgtaatcc

SEQ ID NO: 1009 - DNA, 25 bp, Artificial sequence
  Affy probe set ID: 212624_s_at
gtaagcctgttgtgactttgctttt

SEQ ID NO: 1010 - DNA, 25 bp, Artificial sequence
  Affy probe set ID: 212624_s_at
ggggtctatgtcattggtttctgat

SEQ ID NO: 1011 - DNA, 25 bp, Artificial sequence
  Affy probe set ID: 212624_s_at
gcacctctggctgttacattaccat

SEQ ID NO: 1012 - DNA, 25 bp, Artificial sequence
  Affy probe set ID: 212624_s_at
aaaccatatcacatgcctacatttt

SEQ ID NO: 1013 - DNA, 25 bp, Artificial sequence
  Affy probe set ID: 212624_s_at
ctaacatagtactttctttccagca

SEQ ID NO: 1014 - DNA, 381 bp, Artificial sequence
  Target_Sequence, Fragment of GenBank Accession No. NM_003489
atttaagttgtgattacctgctgcatgaaaagtggcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaat

SEQ ID NO: 1015 - DNA, 25 bp, Artificial sequence
  Affy probe set ID: 202599_s_at
atttaagttgtgattacctgctgca

SEQ ID NO: 1016 - DNA, 25 bp, Artificial sequence
  Affy probe set ID: 202599_s_at
aagtggcatgggggaccctgtgcat

SEQ ID NO: 1017 - DNA, 25 bp, Artificial sequence
  Affy probe set ID: 202599_s_at
gaccctgtgcatctgtgcatttggc

SEQ ID NO: 1018 - DNA, 25 bp, Artificial sequence
  Affy probe set ID: 202599_s_at
tccatttctggacatgacgtctgtg

SEQ ID NO: 1019 - DNA, 25 bp, Artificial sequence
  Affy probe set ID: 202599_s_at
gacgtctgtggtttaagctttgtga

SEQ ID NO: 1020 - DNA, 25 bp, Artificial sequence
  Affy probe set ID: 202599_s_at
aatgtgctttgattcgaagggtctt

SEQ ID NO: 1021 - DNA, 25 bp, Artificial sequence
  Affy probe set ID: 202599_s_at
taatcgtcaaccacttttaaacata

SEQ ID NO: 1022 - DNA, 25 bp, Artificial sequence
  Affy probe set ID: 202599_s_at
agaattcacacaactactttcatga

SEQ ID NO: 1023 - DNA, 25 bp, Artificial sequence
  Affy probe set ID: 202599_s_at
attccaagagtatcccagtattagc

SEQ ID NO: 1024 - DNA, 25 bp, Artificial sequence
  Affy probe set ID: 202599_s_at
atataggcacattaccattcatagt

SEQ ID NO: 1025 - DNA, 25 bp, Artificial sequence
  Affy probe set ID: 202599_s_at
aatttgatgcgatctgctcagtaat

SEQ ID NO: 1026 - DNA, 497 bp, Artificial sequence
  Target_Sequence, Fragment of GenBank Accession No. NM_032646
acaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcac

SEQ ID NO: 1027 - DNA, 25 bp, Artificial sequence
  Affy probe set ID: 223741_s_at
acaggagcttattggccaggaggga

SEQ ID NO: 1028 - DNA, 25 bp, Artificial sequence
  Affy probe set ID: 223741_s_at
tgccaacctggagttcacaacacca

SEQ ID NO: 1029 - DNA, 25 bp, Artificial sequence
  Affy probe set ID: 223741_s_at
gcctcgcacactgaagcaggggcgt

SEQ ID NO: 1030 - DNA, 25 bp, Artificial sequence
  Affy probe set ID: 223741_s_at
ggaagaaccacctgtcatcaaaaca

SEQ ID NO: 1031 - DNA, 25 bp, Artificial sequence
  Affy probe set ID: 223741_s_at
agcctccacaacagaatggggccac

SEQ ID NO: 1032 - DNA, 25 bp, Artificial sequence
  Affy probe set ID: 223741_s_at
aactcactttggtatatccgcgtca

SEQ ID NO: 1033 - DNA, 25 bp, Artificial sequence
  Affy probe set ID: 223741_s_at
gtatatccgcgtcacatgcagagag

SEQ ID NO: 1034 - DNA, 25 bp, Artificial sequence
  Affy probe set ID: 223741_s_at
gaggaactctgcgacgtcaaagtgt

SEQ ID NO: 1035 - DNA, 25 bp, Artificial sequence
  Affy probe set ID: 223741_s_at
aacagattcctcggggagttcctga

SEQ ID NO: 1036 - DNA, 25 bp, Artificial sequence
  Affy probe set ID: 223741_s_at
gaaccaggtgggcaaacctttgctt

SEQ ID NO: 1037 - DNA, 25 bp, Artificial sequence
  Affy probe set ID: 223741_s_at
tttgcttatatacatgcggcctcac

SEQ ID NO: 1038 - DNA, 532 bp, Artificial sequence
  Target_Sequence, Fragment of GenBank Accession No. NM_001312
tcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcagggcccccctgcttggctctgctgggagagtgctagccgc

SEQ ID NO: 1039 - DNA, 25 bp, Artificial sequence
  Affy probe set ID: 208978_at
tcggacccaaaggcgtgaacatcgg

SEQ ID NO: 1040 - DNA, 25 bp, Artificial sequence
  Affy probe set ID: 208978_at
ggctcctacatctacgagaagcccc

SEQ ID NO: 1041 - DNA, 25 bp, Artificial sequence
  Affy probe set ID: 208978_at
gcccgcgctgcagcaagaaggtgta

SEQ ID NO: 1042 - DNA, 25 bp, Artificial sequence
  Affy probe set ID: 208978_at
aaggtgacgtctctgggcaaggatt

SEQ ID NO: 1043 - DNA, 25 bp, Artificial sequence
  Affy probe set ID: 208978_at
ctgggcaaggattggcaccggccct

SEQ ID NO: 1044 - DNA, 25 bp, Artificial sequence
  Affy probe set ID: 208978_at
gagcgctgcgggaagacactgaccc

SEQ ID NO: 1045 - DNA, 25 bp, Artificial sequence
  Affy probe set ID: 208978_at
atcctcttcggacccaagggagtga

SEQ ID NO: 1046 - DNA, 25 bp, Artificial sequence
  Affy probe set ID: 208978_at
tgcggtgggcagctacatctatgac

SEQ ID NO: 1047 - DNA, 25 bp, Artificial sequence
  Affy probe set ID: 208978_at
atctatgaccgggaccccgaaggca

SEQ ID NO: 1048 - DNA, 25 bp, Artificial sequence
  Affy probe set ID: 208978_at
tacagcggctctcatgatgtgggct

SEQ ID NO: 1049 - DNA, 25 bp, Artificial sequence
  Affy probe set ID: 208978_at
gctctgctgggagagtgctagccgc

SEQ ID NO: 1050 - DNA, 424 bp, Artificial sequence
  Target_Sequence, Fragment of GenBank Accession No. NM_023075
  misc_feature (263)..(263): n is a, c, g, or t
agaacctgtcgtaccagcatcatgagctggatgcaggagcccatggctgaaaggagttaaaacgcccagtggtcattaagtgaaacatcttttatcaacctgcaaaagctgcagcgttctctgccaggtcaaatgggcatgtttagaaaataagagaagatggctgagtatagctaatgaataaatggttgtttctttagaaaattaaacacacacagagtgtaagaggagaggatacggccctccctgaaggataaagtccncctggacggtgccctgccctcgcttctcacattaactgcccaggaatgtcatgctgattggttcccggaagggtgtttggcaaggggcagtgtatggagctacgtgtagaaggagagaaatttgtgtgtggcttttgtaaattttgaccgattgcagcaat

SEQ ID NO: 1051 - DNA, 25 bp, Artificial sequence
  Affy probe set ID: 213924_at
agaacctgtcgtaccagcatcatga

SEQ ID NO: 1052 - DNA, 25 bp, Artificial sequence
  Affy probe set ID: 213924_at
ggagttaaaacgcccagtggtcatt

SEQ ID NO: 1053 - DNA, 25 bp, Artificial sequence
  Affy probe set ID: 213924_at
gaaacatcttttatcaacctgcaaa

SEQ ID NO: 1054 - DNA, 25 bp, Artificial sequence
  Affy probe set ID: 213924_at
gcgttctctgccaggtcaaatgggc

SEQ ID NO: 1055 - DNA, 25 bp, Artificial sequence
  Affy probe set ID: 213924_at
tacggccctccctgaaggataaagt

SEQ ID NO: 1056 - DNA, 25 bp, Artificial sequence
  Affy probe set ID: 213924_at
cattaactgcccaggaatgtcatgc

SEQ ID NO: 1057 - DNA, 25 bp, Artificial sequence
  Affy probe set ID: 213924_at
gctgattggttcccggaagggtgtt

SEQ ID NO: 1058 - DNA, 25 bp, Artificial sequence
  Affy probe set ID: 213924_at
gaagggtgtttggcaaggggcagtg

SEQ ID NO: 1059 - DNA, 25 bp, Artificial sequence
  Affy probe set ID: 213924_at
ggggcagtgtatggagctacgtgta

SEQ ID NO: 1060 - DNA, 25 bp, Artificial sequence
  Affy probe set ID: 213924_at
aggagagaaatttgtgtgtggcttt

SEQ ID NO: 1061 - DNA, 25 bp, Artificial sequence
  Affy probe set ID: 213924_at
gtaaattttgaccgattgcagcaat

SEQ ID NO: 1062 - DNA, 540 bp, Artificial sequence
  Target_Sequence, Fragment of GenBank Accession No. NM_004364
aagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatccagagggaccggagttatgacaagcttcccaaatattttgctttatcagccgatatcaacacttgtatctggcctctgtgcccagcagtgccttgtgcaatgtgaatgtaccgtctctgctaaaccaccattttatttggttttgttttgtttggttttctcggatacttgccaaaatgagactctccgtcggcagctgggggaagggtctgagactctctttccttttggttttgggattacttttgatcctgggggaccaatgaggtgaggggggttctcctttgccctcagctttcccagccctccggcctgggctgcccacaaggcttctcccccagaggccctggctcctggtcgggaagggag

SEQ ID NO: 1063 - DNA, 25 bp, Artificial sequence
  Affy probe set ID: 204039_at
aagctaggtcgtgggtcagctctga

SEQ ID NO: 1064 - DNA, 25 bp, Artificial sequence
  Affy probe set ID: 204039_at
agctctgaggatgtatacccctggt

SEQ ID NO: 1065 - DNA, 25 bp, Artificial sequence
  Affy probe set ID: 204039_at
gagggagacctagagatctggctgt

SEQ ID NO: 1066 - DNA, 25 bp, Artificial sequence
  Affy probe set ID: 204039_at
agccttgtttgtactgtatgccttc

SEQ ID NO: 1067 - DNA, 25 bp, Artificial sequence
  Affy probe set ID: 204039_at
atgccttcagcattgcctaggaaca

SEQ ID NO: 1068 - DNA, 25 bp, Artificial sequence
  Affy probe set ID: 204039_at
gaacacgaagcacgatcagtccatc

SEQ ID NO: 1069 - DNA, 25 bp, Artificial sequence
  Affy probe set ID: 204039_at
tcaacacttgtatctggcctctgtg

SEQ ID NO: 1070 - DNA, 25 bp, Artificial sequence
  Affy probe set ID: 204039_at
tgtgaatgtaccgtctctgctaaac

SEQ ID NO: 1071 - DNA, 25 bp, Artificial sequence
  Affy probe set ID: 204039_at
tgtttggttttctcggatacttgcc

SEQ ID NO: 1072 - DNA, 25 bp, Artificial sequence
  Affy probe set ID: 204039_at
gccaaaatgagactctccgtcggca

SEQ ID NO: 1073 - DNA, 25 bp, Artificial sequence
  Affy probe set ID: 204039_at
ccctggctcctggtcgggaagggag

SEQ ID NO: 1074 - DNA, 555 bp, Artificial sequence
  Target_Sequence, Fragment of GenBank Accession No. NM_000248
gggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatc

SEQ ID NO: 1075 - DNA, 25 bp, Artificial sequence
  Affy probe set ID: 207233_s_at
gggactgaggccaaccaagcctata

SEQ ID NO: 1076 - DNA, 25 bp, Artificial sequence
  Affy probe set ID: 207233_s_at
caagcctatagtgtccccacaaaaa

SEQ ID NO: 1077 - DNA, 25 bp, Artificial sequence
  Affy probe set ID: 207233_s_at
cccccggagcttccaaaacaagcag

SEQ ID NO: 1078 - DNA, 25 bp, Artificial sequence
  Affy probe set ID: 207233_s_at
gcagccggaggagcagtatgagcat

SEQ ID NO: 1079 - DNA, 25 bp, Artificial sequence
  Affy probe set ID: 207233_s_at
gagcatggaagagacggagcacact

SEQ ID NO: 1080 - DNA, 25 bp, Artificial sequence
  Affy probe set ID: 207233_s_at
gagcacacttgttagcgaatcctcc

SEQ ID NO: 1081 - DNA, 25 bp, Artificial sequence
  Affy probe set ID: 207233_s_at
gcactgcattcgcacaaactgcttc

SEQ ID NO: 1082 - DNA, 25 bp, Artificial sequence
  Affy probe set ID: 207233_s_at
ttcatgctttatcaatagcccagga

SEQ ID NO: 1083 - DNA, 25 bp, Artificial sequence
  Affy probe set ID: 207233_s_at
accacagactttagctttctgagca

SEQ ID NO: 1084 - DNA, 25 bp, Artificial sequence
  Affy probe set ID: 207233_s_at
agatttttatgcctgtgacttcctt

SEQ ID NO: 1085 - DNA, 25 bp, Artificial sequence
  Affy probe set ID: 207233_s_at
tatgcctgtgacttccttggaaatc

SEQ ID NO: 1086 - DNA, 497 bp, Artificial sequence
  Target_Sequence, Fragment of GenBank Accession No. NM_002185
  misc_feature (286)..(286): n is a, c, g, or t
  misc_feature (452)..(452): n is a, c, g, or t
ctaattggttctgcccaatctcctttcagattttattaggaaaaaaaaataaacctcctgatcggagacaatgtattaatcagaagtgtaaactgccagttctatatagcatgaaatgaaaagacagctaatttggtccaacaaacatgactgggtctagggcacccaggctgattcagctgatttcctaccagcctttgcctcttccttcaatgtggtttccatgggaatttgcttcagaaaagccaagtatgggctgttcagaggtgcacacctgcattttctnagctcttctagaggggctaagagacttggtacgggccaggaagaatatgtggcagagctcctggaaatgatgcagattaggtggcatttttgtcagctctgtggtttattgttgggactattctttaaaatatccattgttcactacagtgaagatctctgatttnaccgtgtactatccacatgcattacaaacatttcgcagagctgct

SEQ ID NO: 1087 - DNA, 25 bp, Artificial sequence
  Affy probe set ID: 226218_at
ctaattggttctgcccaatctcctt

SEQ ID NO: 1088 - DNA, 25 bp, Artificial sequence
  Affy probe set ID: 226218_at
tgactgggtctagggcacccaggct

SEQ ID NO: 1089 - DNA, 25 bp, Artificial sequence
  Affy probe set ID: 226218_at
gattcagctgatttcctaccagcct

SEQ ID NO: 1090 - DNA, 25 bp, Artificial sequence
  Affy probe set ID: 226218_at
tatgggctgttcagaggtgcacacc

SEQ ID NO: 1091 - DNA, 25 bp, Artificial sequence
  Affy probe set ID: 226218_at
aagagacttggtacgggccaggaag

SEQ ID NO: 1092 - DNA, 25 bp, Artificial sequence
  Affy probe set ID: 226218_at
gaatatgtggcagagctcctggaaa

SEQ ID NO: 1093 - DNA, 25 bp, Artificial sequence
  Affy probe set ID: 226218_at
taggtggcatttttgtcagctctgt

SEQ ID NO: 1094 - DNA, 25 bp, Artificial sequence
  Affy probe set ID: 226218_at
gtcagctctgtggtttattgttggg

SEQ ID NO: 1095 - DNA, 25 bp, Artificial sequence
  Affy probe set ID: 226218_at
aaatatccattgttcactacagtga

SEQ ID NO: 1096 - DNA, 25 bp, Artificial sequence
  Affy probe set ID: 226218_at
accgtgtactatccacatgcattac

SEQ ID NO: 1097 - DNA, 25 bp, Artificial sequence
  Affy probe set ID: 226218_at
attacaaacatttcgcagagctgct

SEQ ID NO: 1098 - DNA, 369 bp, Artificial sequence
  Target_Sequence, Fragment of GenBank Accession No. NM_021638
gtgtagccatggaagatactttcaaaaggacatcttcagatcataagtcttaggaccaaaggtgtttttaatgagataatctttttgattttctaacaagaaaggaaatattcactttacattttaacatcaacttttaagtgatactcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattca

SEQ ID NO: 1099 - DNA, 25 bp, Artificial sequence
  Affy probe set ID: 203563_at
gtgtagccatggaagatactttcaa

SEQ ID NO: 1100 - DNA, 25 bp, Artificial sequence
  Affy probe set ID: 203563_at
atcttcagatcataagtcttaggac

SEQ ID NO: 1101 - DNA, 25 bp, Artificial sequence
  Affy probe set ID: 203563_at
gagataatctttttgattttctaac

SEQ ID NO: 1102 - DNA, 25 bp, Artificial sequence
  Affy probe set ID: 203563_at
ttcactttacattttaacatcaact

SEQ ID NO: 1103 - DNA, 25 bp, Artificial sequence
  Affy probe set ID: 203563_at
aacatcaacttttaagtgatactca

SEQ ID NO: 1104 - DNA, 25 bp, Artificial sequence
  Affy probe set ID: 203563_at
gtgatactcagaattaattgaccat

SEQ ID NO: 1105 - DNA, 25 bp, Artificial sequence
  Affy probe set ID: 203563_at
attgaccatggtgatacgttgtaaa

SEQ ID NO: 1106 - DNA, 25 bp, Artificial sequence
  Affy probe set ID: 203563_at
agaatgtaattatttccttattgta

SEQ ID NO: 1107 - DNA, 25 bp, Artificial sequence
  Affy probe set ID: 203563_at
aaatatgttagtagtgcccacttca

SEQ ID NO: 1108 - DNA, 25 bp, Artificial sequence
  Affy probe set ID: 203563_at
gtagtgcccacttcaaatgactgta

SEQ ID NO: 1109 - DNA, 25 bp, Artificial sequence
  Affy probe set ID: 203563_at
actgtttctcaatgtatttaattca

SEQ ID NO: 1110 - DNA, 382 bp, Artificial sequence
  Target_Sequence, Fragment of GenBank Accession No. NM_003786
gatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtcccccggtctcccgattcccaactgagtgttatttgcacactgcactgttttcaaataacgattttatgaaatgacctctgtcctccctctgatttttcatattttcctaaagtttcgtttctgttttttaataaaaagctttttcctcctggaacagaagacagctgctgggtcaggccacccctaggaactcagtcctgtactctggggtgctgcctgaatccattaaaaat

SEQ ID NO: 1111 - DNA, 25 bp, Artificial sequence
  Affy probe set ID: 208161_s_at
gatagcaaacactgggggcacctta

SEQ ID NO: 1112 - DNA, 25 bp, Artificial sequence
  Affy probe set ID: 208161_s_at
ttttgcacctgtaaagtgccttaca

SEQ ID NO: 1113 - DNA, 25 bp, Artificial sequence
  Affy probe set ID: 208161_s_at
gatccccaagtggtgaatgacacgc

SEQ ID NO: 1114 - DNA, 25 bp, Artificial sequence
  Affy probe set ID: 208161_s_at
tgaatgacacgcctaaggtcacagc

SEQ ID NO: 1115 - DNA, 25 bp, Artificial sequence
  Affy probe set ID: 208161_s_at
gtttgagccagttagactagtcccc

SEQ ID NO: 1116 - DNA, 25 bp, Artificial sequence
  Affy probe set ID: 208161_s_at
tctcccgattcccaactgagtgtta

SEQ ID NO: 1117 - DNA, 25 bp, Artificial sequence
  Affy probe set ID: 208161_s_at
tttgcacactgcactgttttcaaat

SEQ ID NO: 1118 - DNA, 25 bp, Artificial sequence
  Affy probe set ID: 208161_s_at
tcctccctctgatttttcatatttt

SEQ ID NO: 1119 - DNA, 25 bp, Artificial sequence
  Affy probe set ID: 208161_s_at
tggaacagaagacagctgctgggtc

SEQ ID NO: 1120 - DNA, 25 bp, Artificial sequence
  Affy probe set ID: 208161_s_at
cacccctaggaactcagtcctgtac

SEQ ID NO: 1121 - DNA, 25 bp, Artificial sequence
  Affy probe set ID: 208161_s_at
ggtgctgcctgaatccattaaaaat

SEQ ID NO: 1122 - DNA, 314 bp, Artificial sequence
  Target_Sequence, Fragment of predicted locus LOC730351 on human chromosome 7p22.2
  misc_feature (175)..(175): n is a, c, g, or t
gctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccngtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacg

SEQ ID NO: 1123 - DNA, 25 bp, Artificial sequence
  Affy probe set ID: 229407_at
gctcactctgtacaggtcttcggag

SEQ ID NO: 1124 - DNA, 25 bp, Artificial sequence
  Affy probe set ID: 229407_at
cttcggaggccgtgtttgtatctaa

SEQ ID NO: 1125 - DNA, 25 bp, Artificial sequence
  Affy probe set ID: 229407_at
gtatctaactgtgactgggctgaag

SEQ ID NO: 1126 - DNA, 25 bp, Artificial sequence
  Affy probe set ID: 229407_at
gcatgatgtttgcctaatggttcgt

SEQ ID NO: 1127 - DNA, 25 bp, Artificial sequence
  Affy probe set ID: 229407_at
tggttcgtagcatggtttttatttc

SEQ ID NO: 1128 - DNA, 25 bp, Artificial sequence
  Affy probe set ID: 229407_at
atttcttacgcattcttggcacaca

SEQ ID NO: 1129 - DNA, 25 bp, Artificial sequence
  Affy probe set ID: 229407_at
ttggcacacagtgtagctatcctcc

SEQ ID NO: 1130 - DNA, 25 bp, Artificial sequence
  Affy probe set ID: 229407_at
gcgtcctggtagcatggatccagtc

SEQ ID NO: 1131 - DNA, 25 bp, Artificial sequence
  Affy probe set ID: 229407_at
tggaaactcatgagctgagcctgcc

SEQ ID NO: 1132 - DNA, 25 bp, Artificial sequence
  Affy probe set ID: 229407_at
gcgtcaccttctggtttagggagcc

SEQ ID NO: 1133 - DNA, 25 bp, Artificial sequence
  Affy probe set ID: 229407_at
tagggagccgtcaggtccctaaacg

SEQ ID NO: 1134 - DNA, 497 bp, Artificial sequence
  Target_Sequence, Fragment of GenBank Accession No. NM_012153
tgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccagg

SEQ ID NO: 1135 - DNA, 25 bp, Artificial sequence
  Affy probe set ID: 225645_at
tgcctgctatgtgcacggcatgggc

SEQ ID NO: 1136 - DNA, 25 bp, Artificial sequence
  Affy probe set ID: 225645_at
gcacggcatgggcccatatgtgtga

SEQ ID NO: 1137 - DNA, 25 bp, Artificial sequence
  Affy probe set ID: 225645_at
gatctcggtagttacgtattgggca

SEQ ID NO: 1138 - DNA, 25 bp, Artificial sequence
  Affy probe set ID: 225645_at
aattatcctcagtgtagcttcttgg

SEQ ID NO: 1139 - DNA, 25 bp, Artificial sequence
  Affy probe set ID: 225645_at
aaaactcctgttgagactgtgtctt

SEQ ID NO: 1140 - DNA, 25 bp, Artificial sequence
  Affy probe set ID: 225645_at
gactgtgtcttatgaacctctgaaa

SEQ ID NO: 1141 - DNA, 25 bp, Artificial sequence
  Affy probe set ID: 225645_at
gaacctctgaaacgtacaagccttc

SEQ ID NO: 1142 - DNA, 25 bp, Artificial sequence
  Affy probe set ID: 225645_at
aatctttctgtagttatctgcataa

SEQ ID NO: 1143 - DNA, 25 bp, Artificial sequence
  Affy probe set ID: 225645_at
ctggctcctgggttgacaatttgtg

SEQ ID NO: 1144 - DNA, 25 bp, Artificial sequence
  Affy probe set ID: 225645_at
gaaacaactctattgctactattta

SEQ ID NO: 1145 - DNA, 25 bp, Artificial sequence
  Affy probe set ID: 225645_at
gtttatttgtttgatgggtcccagg

SEQ ID NO: 1146 - DNA, 503 bp, Artificial sequence
  Target_Sequence, Fragment of GenBank Accession No. NM_004887
gaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaaga

SEQ ID NO: 1147 - DNA, 25 bp, Artificial sequence
  Affy probe set ID: 222484_s_at
gaaacatttccaagatcctgtgatg

SEQ ID NO: 1148 - DNA, 25 bp, Artificial sequence
  Affy probe set ID: 222484_s_at
agcatgtgaggttcccaacactgtc

SEQ ID NO: 1149 - DNA, 25 bp, Artificial sequence
  Affy probe set ID: 222484_s_at
gcgcaatacacagctacagacacac

SEQ ID NO: 1150 - DNA, 25 bp, Artificial sequence
  Affy probe set ID: 222484_s_at
ccttcaaagcatgtttctttccctc

SEQ ID NO: 1151 - DNA, 25 bp, Artificial sequence
  Affy probe set ID: 222484_s_at
tccctcaccacaacagaacatgcag

SEQ ID NO: 1152 - DNA, 25 bp, Artificial sequence
  Affy probe set ID: 222484_s_at
gtgattccccatgtaattcttcaat

SEQ ID NO: 1153 - DNA, 25 bp, Artificial sequence
  Affy probe set ID: 222484_s_at
taaacagtgcagtcctctttcgaaa

SEQ ID NO: 1154 - DNA, 25 bp, Artificial sequence
  Affy probe set ID: 222484_s_at
aaagctaagatgaccatgcgccctt

SEQ ID NO: 1155 - DNA, 25 bp, Artificial sequence
  Affy probe set ID: 222484_s_at
ccccccagtatatgccgcattgtac

SEQ ID NO: 1156 - DNA, 25 bp, Artificial sequence
  Affy probe set ID: 222484_s_at
atgccgcattgtactgctgtgttat

SEQ ID NO: 1157 - DNA, 25 bp, Artificial sequence
  Affy probe set ID: 222484_s_at
tgcaggtttcatattctttctaaga

SEQ ID NO: 1158 - DNA, 434 bp, Artificial sequence
  Target_Sequence, Fragment of GenBank Accession No. NM_002030
  misc_feature (92)..(93): n is a, c, g, or t
gtttcctgaggcttaatacacccaacattataacaaaggactgtagcaagggctatgggagttctgaagcagaaaccatgggctaaaaccannatacatcttaataccagataccctaatcccagtcctaacttcatttaaccttggtcacattgagtcattccaggatgagtggctcaagtatttcctcagggaaaatacttctgtgccccctgatttgagggtaagaagtagataatgaggccactgtgggtgttattttttcatgtctggacctcagcctatatcctgagactaagtggaagtgggaaaagagtacaagagaagagacaaagtggggatatttgtaaggcttagatgagatagtgtttttttagaaaaaaactttatcttaccattaagtaaaatgtttgccataggctttctggggcttt

SEQ ID NO: 1159 - DNA, 25 bp, Artificial sequence
  Affy probe set ID: 230422_at
gtttcctgaggcttaatacacccaa

SEQ ID NO: 1160 - DNA, 25 bp, Artificial sequence
  Affy probe set ID: 230422_at
tagcaagggctatgggagttctgaa

SEQ ID NO: 1161 - DNA, 25 bp, Artificial sequence
  Affy probe set ID: 230422_at
taataccagataccctaatcccagt

SEQ ID NO: 1162 - DNA, 25 bp, Artificial sequence
  Affy probe set ID: 230422_at
tcctaacttcatttaaccttggtca

SEQ ID NO: 1163 - DNA, 25 bp, Artificial sequence
  Affy probe set ID: 230422_at
aaccttggtcacattgagtcattcc

SEQ ID NO: 1164 - DNA, 25 bp, Artificial sequence
  Affy probe set ID: 230422_at
gagtggctcaagtatttcctcaggg

SEQ ID NO: 1165 - DNA, 25 bp, Artificial sequence
  Affy probe set ID: 230422_at
agggaaaatacttctgtgccccctg

SEQ ID NO: 1166 - DNA, 25 bp, Artificial sequence
  Affy probe set ID: 230422_at
ccactgtgggtgttattttttcatg

SEQ ID NO: 1167 - DNA, 25 bp, Artificial sequence
  Affy probe set ID: 230422_at
ttttttcatgtctggacctcagcct

SEQ ID NO: 1168 - DNA, 25 bp, Artificial sequence
  Affy probe set ID: 230422_at
ggacctcagcctatatcctgagact

SEQ ID NO: 1169 - DNA, 25 bp, Artificial sequence
  Affy probe set ID: 230422_at
tttgccataggctttctggggcttt

SEQ ID NO: 1170 - DNA, 124 bp, Artificial sequence
  Target_Sequence, Fragment of GenBank Accession No. NM_001321
aactactgtgaaattctaccagcattaagtactgtatatcgccctgtacttggataggctggctaactcgtaggaagagagcactgtatggtatccttttgctttattcaccagcattttgggg

SEQ ID NO: 1171 - DNA, 25 bp, Artificial sequence
  Affy probe set ID: 207030_s_at
aactactgtgaaattctaccagcat

SEQ ID NO: 1172 - DNA, 25 bp, Artificial sequence
  Affy probe set ID: 207030_s_at
gtgaaattctaccagcattaagtac

SEQ ID NO: 1173 - DNA, 25 bp, Artificial sequence
  Affy probe set ID: 207030_s_at
ttaagtactgtatatcgccctgtac

SEQ ID NO: 1174 - DNA, 25 bp, Artificial sequence
  Affy probe set ID: 207030_s_at
ctgtatatcgccctgtacttggata

SEQ ID NO: 1175 - DNA, 25 bp, Artificial sequence
  Affy probe set ID: 207030_s_at
atatcgccctgtacttggataggct

SEQ ID NO: 1176 - DNA, 25 bp, Artificial sequence
  Affy probe set ID: 207030_s_at
cgccctgtacttggataggctggct

SEQ ID NO: 1177 - DNA, 25 bp, Artificial sequence
  Affy probe set ID: 207030_s_at
gtacttggataggctggctaactcg

SEQ ID NO: 1178 - DNA, 25 bp, Artificial sequence
  Affy probe set ID: 207030_s_at
ggataggctggctaactcgtaggaa

SEQ ID NO: 1179 - DNA, 25 bp, Artificial sequence
  Affy probe set ID: 207030_s_at
gctggctaactcgtaggaagagagc

SEQ ID NO: 1180 - DNA, 25 bp, Artificial sequence
  Affy probe set ID: 207030_s_at
gaagagagcactgtatggtatcctt

SEQ ID NO: 1181 - DNA, 25 bp, Artificial sequence
  Affy probe set ID: 207030_s_at
tgctttattcaccagcattttgggg

SEQ ID NO: 1182 - DNA, 510 bp, Artificial sequence
  Target_Sequence, Fragment of GenBank Accession No. NM_001945
gagccactctatgagttggacttcagtcttgcctaggcgattttgtctaccatttgtgttttgaaagcccaaggtgctgatgtcaaagtgtaacagatatcagtgtctccccgtgtcctctccctgccaagtctcagaagaggttgggcttccatgcctgtagctttcctggtccctcacccccatggccccaggccacagcgtgggaactcactttcccttgtgtcaagacatttctctaactcctgccattcttctggtgctactccatgcaggggtcagtgcagcagaggacagtctggagaaggtattagcaaagcaaaaggctgagaaggaacagggaacattggagctgactgttcttggtaactgattacctgccaattgctaccgagaaggttggaggtggggaaggctttgtataatcccacccacctcaccaaaacgatgaaggtatgctgtcatggtcctttctggaagtttctggtgccatttctgaactgttacaac

SEQ ID NO: 1183 - DNA, 25 bp, Artificial sequence
  Affy probe set ID: 203821_at
gagccactctatgagttggacttca

SEQ ID NO: 1184 - DNA, 25 bp, Artificial sequence
  Affy probe set ID: 203821_at
cagtcttgcctaggcgattttgtct

SEQ ID NO: 1185 - DNA, 25 bp, Artificial sequence
  Affy probe set ID: 203821_at
ggcgattttgtctaccatttgtgtt

SEQ ID NO: 1186 - DNA, 25 bp, Artificial sequence
  Affy probe set ID: 203821_at
gtaacagatatcagtgtctccccgt

SEQ ID NO: 1187 - DNA, 25 bp, Artificial sequence
  Affy probe set ID: 203821_at
tctccctgccaagtctcagaagagg

SEQ ID NO: 1188 - DNA, 25 bp, Artificial sequence
  Affy probe set ID: 203821_at
ccaggccacagcgtgggaactcact

SEQ ID NO: 1189 - DNA, 25 bp, Artificial sequence
  Affy probe set ID: 203821_at
actcactttcccttgtgtcaagaca

SEQ ID NO: 1190 - DNA, 25 bp, Artificial sequence
  Affy probe set ID: 203821_at
gtcaagacatttctctaactcctgc

SEQ ID NO: 1191 - DNA, 25 bp, Artificial sequence
  Affy probe set ID: 203821_at
attggagctgactgttcttggtaac

SEQ ID NO: 1192 - DNA, 25 bp, Artificial sequence
  Affy probe set ID: 203821_at
tatgctgtcatggtcctttctggaa

SEQ ID NO: 1193 - DNA, 25 bp, Artificial sequence
  Affy probe set ID: 203821_at
ggtgccatttctgaactgttacaac

SEQ ID NO: 1194 - DNA, 456 bp, Artificial sequence
  Target_Sequence, Fragment of GenBank Accession No. NM_031412
gactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaa

SEQ ID NO: 1195 - DNA, 25 bp, Artificial sequence
  Affy probe set ID: 208869_s_at
gactaaaaccactcttagcatctcc

SEQ ID NO: 1196 - DNA, 25 bp, Artificial sequence
  Affy probe set ID: 208869_s_at
gaggtgtcttatgtagggagggggc

SEQ ID NO: 1197 - DNA, 25 bp, Artificial sequence
  Affy probe set ID: 208869_s_at
gggagggggcaagtatgaagtaagg

SEQ ID NO: 1198 - DNA, 25 bp, Artificial sequence
  Affy probe set ID: 208869_s_at
aaggtaattatatactactctcatt

SEQ ID NO: 1199 - DNA, 25 bp, Artificial sequence
  Affy probe set ID: 208869_s_at
attatatactactctcattcaggat

SEQ ID NO: 1200 - DNA, 25 bp, Artificial sequence
  Affy probe set ID: 208869_s_at
tcccttcaggctcacatgcacagga

SEQ ID NO: 1201 - DNA, 25 bp, Artificial sequence
  Affy probe set ID: 208869_s_at
atgcacaggaatgctacatgatggc

SEQ ID NO: 1202 - DNA, 25 bp, Artificial sequence
  Affy probe set ID: 208869_s_at
ttcacttttgggattttgtggggtg

SEQ ID NO: 1203 - DNA, 25 bp, Artificial sequence
  Affy probe set ID: 208869_s_at
ggttctttctcttgggggaaatgtg

SEQ ID NO: 1204 - DNA, 25 bp, Artificial sequence
  Affy probe set ID: 208869_s_at
ataatgaagtcaatgccatcaggcc

SEQ ID NO: 1205 - DNA, 25 bp, Artificial sequence
  Affy probe set ID: 208869_s_at
atgccatcaggccaaggaaataaaa

SEQ ID NO: 1206 - DNA, 558 bp, Artificial sequence
  Target_Sequence, Fragment of GenBank Accession No. NM_006022
acaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaa

SEQ ID NO: 1207 - DNA, 25 bp, Artificial sequence
  Affy probe set ID: 215111_s_at
acaatagtactgtgcctctttcttc

SEQ ID NO: 1208 - DNA, 25 bp, Artificial sequence
  Affy probe set ID: 215111_s_at
cctctttcttctcaaacaatggatg

SEQ ID NO: 1209 - DNA, 25 bp, Artificial sequence
  Affy probe set ID: 215111_s_at
ggtgacaggtagctgggacctaggc

SEQ ID NO: 1210 - DNA, 25 bp, Artificial sequence
  Affy probe set ID: 215111_s_at
ggacctaggctatcttaccatgaag

SEQ ID NO: 1211 - DNA, 25 bp, Artificial sequence
  Affy probe set ID: 215111_s_at
aatttggcacagttactcactttgt

SEQ ID NO: 1212 - DNA, 25 bp, Artificial sequence
  Affy probe set ID: 215111_s_at
gaaatctagctgctgaatacgctga

SEQ ID NO: 1213 - DNA, 25 bp, Artificial sequence
  Affy probe set ID: 215111_s_at
aaatccttgttcactgaagtctttc

SEQ ID NO: 1214 - DNA, 25 bp, Artificial sequence
  Affy probe set ID: 215111_s_at
ggatttcccagtaggggtttctgca

SEQ ID NO: 1215 - DNA, 25 bp, Artificial sequence
  Affy probe set ID: 215111_s_at
gtttctgcatatcacctgtatagta

SEQ ID NO: 1216 - DNA, 25 bp, Artificial sequence
  Affy probe set ID: 215111_s_at
gtgcatgttctctacacaattgtaa

SEQ ID NO: 1217 - DNA, 25 bp, Artificial sequence
  Affy probe set ID: 215111_s_at
aactgttgcacttgtcaactttcaa

SEQ ID NO: 1218 - DNA, 438 bp, Artificial sequence
  Target_Sequence, Fragment of GenBank Accession No. NM_016174
  misc_feature (259)..(259): n is a, c, g, or t
  misc_feature (262)..(262): n is a, c, g, or t
  misc_feature (264)..(264): n is a, c, g, or t
  misc_feature (341)..(341): n is a, c, g, or t
gagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgattncangnccttgtggcccccagcttctgtttcaagctgggcagaccccaggatcccttccctccctaaggactcagctgagggncccctctgcccccttctacctccacctcagcaccctcccccagcttgatgtttgggtctccccagcaccctcctccctggccggtgcaaagtacagg

SEQ ID NO: 1219 - DNA, 25 bp, Artificial sequence
  Affy probe set ID: 224794_s_at
gagatgagctctaggtccaggtgat

SEQ ID NO: 1220 - DNA, 25 bp, Artificial sequence
  Affy probe set ID: 224794_s_at
ggaggaggttgttggcagggactgc

SEQ ID NO: 1221 - DNA, 25 bp, Artificial sequence
  Affy probe set ID: 224794_s_at
ttggcagggactgcagatcctgtca

SEQ ID NO: 1222 - DNA, 25 bp, Artificial sequence
  Affy probe set ID: 224794_s_at
ggacctgtctttcatcgggagaaac

SEQ ID NO: 1223 - DNA, 25 bp, Artificial sequence
  Affy probe set ID: 224794_s_at
gaaaccactcagagatggatcccat

SEQ ID NO: 1224 - DNA, 25 bp, Artificial sequence
  Affy probe set ID: 224794_s_at
tggatcccattccctaaaggtctca

SEQ ID NO: 1225 - DNA, 25 bp, Artificial sequence
  Affy probe set ID: 224794_s_at
agcaaaggagcaggactcccaggcc

SEQ ID NO: 1226 - DNA, 25 bp, Artificial sequence
  Affy probe set ID: 224794_s_at
ttctgtttcaagctgggcagacccc

SEQ ID NO: 1227 - DNA, 25 bp, Artificial sequence
  Affy probe set ID: 224794_s_at
tccctccctaaggactcagctgagg

SEQ ID NO: 1228 - DNA, 25 bp, Artificial sequence
  Affy probe set ID: 224794_s_at
cctcccccagcttgatgtttgggtc

SEQ ID NO: 1229 - DNA, 25 bp, Artificial sequence
  Affy probe set ID: 224794_s_at
ctccctggccggtgcaaagtacagg

SEQ ID NO: 1230 - DNA, 531 bp, Artificial sequence
  Target_Sequence, Fragment of GenBank Accession No. NM_015103
atcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggct

SEQ ID NO: 1231 - DNA, 25 bp, Artificial sequence
  Affy probe set ID: 212235_at
atcctggccacagacagtttcaagt

SEQ ID NO: 1232 - DNA, 25 bp, Artificial sequence
  Affy probe set ID: 212235_at
ttgcttgggcggctgttggtagagt

SEQ ID NO: 1233 - DNA, 25 bp, Artificial sequence
  Affy probe set ID: 212235_at
tggtagagtgggcagtgcccgcgcc

SEQ ID NO: 1234 - DNA, 25 bp, Artificial sequence
  Affy probe set ID: 212235_at
gatggggggcacaggagctgggagc

SEQ ID NO: 1235 - DNA, 25 bp, Artificial sequence
  Affy probe set ID: 212235_at
agatgcaccgaggctgtagctgggc

SEQ ID NO: 1236 - DNA, 25 bp, Artificial sequence
  Affy probe set ID: 212235_at
gtagctgggctacttgatcttgctg

SEQ ID NO: 1237 - DNA, 25 bp, Artificial sequence
  Affy probe set ID: 212235_at
aaaaacgtatcatgcaccaactgtg

SEQ ID NO: 1238 - DNA, 25 bp, Artificial sequence
  Affy probe set ID: 212235_at
caccaactgtgaatagctgccgctt

SEQ ID NO: 1239 - DNA, 25 bp, Artificial sequence
  Affy probe set ID: 212235_at
gactgttccagagagcgggcagacc

SEQ ID NO: 1240 - DNA, 25 bp, Artificial sequence
  Affy probe set ID: 212235_at
tgtggccgatgggccatgcgggccc

SEQ ID NO: 1241 - DNA, 25 bp, Artificial sequence
  Affy probe set ID: 212235_at
gactggctcagagcccatgggggct

SEQ ID NO: 1242 - DNA, 544 bp, Artificial sequence
  Target_Sequence, Fragment of GenBank Accession No. NM_003270
acgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttaggtcccccctgtgaattagaaagttgcttggctggagaactgacagcactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccacctt

SEQ ID NO: 1243 - DNA, 25 bp, Artificial sequence
  Affy probe set ID: 209109_s_at
acgttgcattgttgtggtgtcaccg

SEQ ID NO: 1244 - DNA, 25 bp, Artificial sequence
  Affy probe set ID: 209109_s_at
aaggatttcctaagagttgctgtaa

SEQ ID NO: 1245 - DNA, 25 bp, Artificial sequence
  Affy probe set ID: 209109_s_at
taaacttgaagattgtactccacag

SEQ ID NO: 1246 - DNA, 25 bp, Artificial sequence
  Affy probe set ID: 209109_s_at
gggagtcgttgcaggaatttccttt

SEQ ID NO: 1247 - DNA, 25 bp, Artificial sequence
  Affy probe set ID: 209109_s_at
atttcctttggagttgcttgcttcc

SEQ ID NO: 1248 - DNA, 25 bp, Artificial sequence
  Affy probe set ID: 209109_s_at
gagttgcttgcttccaactgattgg

SEQ ID NO: 1249 - DNA, 25 bp, Artificial sequence
  Affy probe set ID: 209109_s_at
actgattggaatctttctcgcctac

SEQ ID NO: 1250 - DNA, 25 bp, Artificial sequence
  Affy probe set ID: 209109_s_at
tgcctctctcgtgccataacaaata

SEQ ID NO: 1251 - DNA, 25 bp, Artificial sequence
  Affy probe set ID: 209109_s_at
gtaacccaatgtatctgtgggccta

SEQ ID NO: 1252 - DNA, 25 bp, Artificial sequence
  Affy probe set ID: 209109_s_at
aaactacaccaataggctgattcaa

SEQ ID NO: 1253 - DNA, 25 bp, Artificial sequence
  Affy probe set ID: 209109_s_at
gtttgctatgttctaagtccacctt

SEQ ID NO: 1254 - DNA, 536 bp, Artificial sequence
  Target_Sequence, Fragment of GenBank Accession No. NM_000887
cagttctgaatatgctgctcatccccacctgtcttcaacagctccccattaccctcaggacaatgtctgaactctccagcttcgcgtgagaagtccccttccatcccagagggtgggcttcagggcgcacagcatgagagcctctgtgcccccatcaccctcgtttccagtgaattagtgtcatgtcagcatcagctcagggcttcatcgtggggctctcagttccgattccccaggctgaattgggagtgagatgcctgcatgctgggttctgcacagctggcctcccgcggttgggtcaacattgctggcctggaagggaggagcgccctctagggagggacatggccccggtgcggctgcagctcaccagccccaggggcagaagagacccaaccacttcctattttttgaggctatgaatatagtacctgaaaaaatgccaagcactagattatttttttaaaaagcgtactttaaatgtttgtgttaatacacattaaaacatcgcacaaaaacgatgcatctaccgctcc

SEQ ID NO: 1255 - DNA, 25 bp, Artificial sequence
  Affy probe set ID: 210184_at
cagttctgaatatgctgctcatccc

SEQ ID NO: 1256 - DNA, 25 bp, Artificial sequence
  Affy probe set ID: 210184_at
aggacaatgtctgaactctccagct

SEQ ID NO: 1257 - DNA, 25 bp, Artificial sequence
  Affy probe set ID: 210184_at
aactctccagcttcgcgtgagaagt

SEQ ID NO: 1258 - DNA, 25 bp, Artificial sequence
  Affy probe set ID: 210184_at
ttcagggcgcacagcatgagagcct

SEQ ID NO: 1259 - DNA, 25 bp, Artificial sequence
  Affy probe set ID: 210184_at
catcaccctcgtttccagtgaatta

SEQ ID NO: 1260 - DNA, 25 bp, Artificial sequence
  Affy probe set ID: 210184_at
ttccgattccccaggctgaattggg

SEQ ID NO: 1261 - DNA, 25 bp, Artificial sequence
  Affy probe set ID: 210184_at
tgagatgcctgcatgctgggttctg

SEQ ID NO: 1262 - DNA, 25 bp, Artificial sequence
  Affy probe set ID: 210184_at
ctggaagggaggagcgccctctagg

SEQ ID NO: 1263 - DNA, 25 bp, Artificial sequence
  Affy probe set ID: 210184_at
aggggcagaagagacccaaccactt

SEQ ID NO: 1264 - DNA, 25 bp, Artificial sequence
  Affy probe set ID: 210184_at
caaccacttcctattttttgaggct

SEQ ID NO: 1265 - DNA, 25 bp, Artificial sequence
  Affy probe set ID: 210184_at
acaaaaacgatgcatctaccgctcc

SEQ ID NO: 1266 - DNA, 328 bp, Artificial sequence
  Target_Sequence, Fragment of GenBank Accession No. NM_001864
ctacgcgtgtccttgggcggagaagggaggtgactccggcggaagaggacaaggcagaatgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagact

SEQ ID NO: 1267 - DNA, 25 bp, Artificial sequence
  Affy probe set ID: 204570_at
ctacgcgtgtccttgggcggagaag

SEQ ID NO: 1268 - DNA, 25 bp, Artificial sequence
  Affy probe set ID: 204570_at
gaagggaggtgactccggcggaaga

SEQ ID NO: 1269 - DNA, 25 bp, Artificial sequence
  Affy probe set ID: 204570_at
caaggcagaatgcaggcccttcggg

SEQ ID NO: 1270 - DNA, 25 bp, Artificial sequence
  Affy probe set ID: 204570_at
gaaccgctttcagaaccgagtgcgc

SEQ ID NO: 1271 - DNA, 25 bp, Artificial sequence
  Affy probe set ID: 204570_at
gcgcgagaaacagaagctcttccag

SEQ ID NO: 1272 - DNA, 25 bp, Artificial sequence
  Affy probe set ID: 204570_at
aggacaatgacatcccgttgtacct

SEQ ID NO: 1273 - DNA, 25 bp, Artificial sequence
  Affy probe set ID: 204570_at
gtacctgaagggcggcatcgttgac

SEQ ID NO: 1274 - DNA, 25 bp, Artificial sequence
  Affy probe set ID: 204570_at
ggcatcgttgacaacatcctgtacc

SEQ ID NO: 1275 - DNA, 25 bp, Artificial sequence
  Affy probe set ID: 204570_at
atcctgtaccgagtgacaatgacgc

SEQ ID NO: 1276 - DNA, 25 bp, Artificial sequence
  Affy probe set ID: 204570_at
acaatgacgctgtgtctgggcggca

SEQ ID NO: 1277 - DNA, 25 bp, Artificial sequence
  Affy probe set ID: 204570_at
agaagcctggggggcctgagagact

SEQ ID NO: 1278 - DNA, 437 bp, Artificial sequence
  Target_Sequence, Fragment of GenBank Accession No. CR599008
ctgtgctccttggacactttgcacagccccagtgggcttctttctcctctgttagtgtggttaatgttcatctgcctgcatccctgagtcacccaagtgtaacctcagccataacacgtactgcagccggaacggtgtccgcagctcagcgtccctctcccatgcactttctgaactttggtcttttaaccaggtttaccagccgctttctgcctctttgtgcttttgagggttttttggtttgtttgttctgttttgtttttaaataaagatgattatttggcccaggctgagggtgcaaacagaactcttcacgtgtccacgacaagaaaaatagtttttacaaacttctagttgtggcatcaaaagtgtgagtttttgcacctgcaaaattgtaatgcaagccctgactgggtggaagctgaagtcttgctgtt

SEQ ID NO: 1279 - DNA, 25 bp, Artificial sequence
  Affy probe set ID: 227970_at
ctgtgctccttggacactttgcaca

SEQ ID NO: 1280 - DNA, 25 bp, Artificial sequence
  Affy probe set ID: 227970_at
ttctttctcctctgttagtgtggtt

SEQ ID NO: 1281 - DNA, 25 bp, Artificial sequence
  Affy probe set ID: 227970_at
gtggttaatgttcatctgcctgcat

SEQ ID NO: 1282 - DNA, 25 bp, Artificial sequence
  Affy probe set ID: 227970_at
catccctgagtcacccaagtgtaac

SEQ ID NO: 1283 - DNA, 25 bp, Artificial sequence
  Affy probe set ID: 227970_at
gtaacctcagccataacacgtactg

SEQ ID NO: 1284 - DNA, 25 bp, Artificial sequence
  Affy probe set ID: 227970_at
cacgtactgcagccggaacggtgtc

SEQ ID NO: 1285 - DNA, 25 bp, Artificial sequence
  Affy probe set ID: 227970_at
tttctgcctctttgtgcttttgagg

SEQ ID NO: 1286 - DNA, 25 bp, Artificial sequence
  Affy probe set ID: 227970_at
gaactcttcacgtgtccacgacaag

SEQ ID NO: 1287 - DNA, 25 bp, Artificial sequence
  Affy probe set ID: 227970_at
aagtgtgagtttttgcacctgcaaa

SEQ ID NO: 1288 - DNA, 25 bp, Artificial sequence
  Affy probe set ID: 227970_at
atgcaagccctgactgggtggaagc

SEQ ID NO: 1289 - DNA, 25 bp, Artificial sequence
  Affy probe set ID: 227970_at
gggtggaagctgaagtcttgctgtt

SEQ ID NO: 1290 - DNA, 539 bp, Artificial sequence
  Target_Sequence, Fragment of GenBank Accession No. NM_198580
  misc_feature (374)..(374): n is a, c, g, or t
gtgaccacttggatgtcaccactgtcagcccctgccttgatgtccccatttagccatctccatggagctcctgctggagggccctgaaccctgcactgcgtggctgcccagccagctgcctcctgtcctgggaggaggcctcctgggtgtcctcatctggtgtgtctactggagggtcccacaggagaggcagcagaggggtcaggggaggtctcctgccgggggttggcctctcaagcctcaggggttctagcctgttgaatataccccacctggtggtggcccctccgatgtccccactgatggctctgacaccgtgttggtggcgatgtcccagacaatcccaccaggacggcccagacatccctactggnttcgctggtggctcatctcgaacatccacgccagcctttctggggccggccacccaggccgcctgtccgtctgtcctccctccagcagcaccccctggcccctggagtggtggggccatggcaagagacaccgtggcgtctcatgtgaactttcctgggcactgt

SEQ ID NO: 1291 - DNA, 25 bp, Artificial sequence
  Affy probe set ID: 226728_at
gtgaccacttggatgtcaccactgt

SEQ ID NO: 1292 - DNA, 25 bp, Artificial sequence
  Affy probe set ID: 226728_at
gtcctcatctggtgtgtctactgga

SEQ ID NO: 1293 - DNA, 25 bp, Artificial sequence
  Affy probe set ID: 226728_at
gtctactggagggtcccacaggaga

SEQ ID NO: 1294 - DNA, 25 bp, Artificial sequence
  Affy probe set ID: 226728_at
caagcctcaggggttctagcctgtt

SEQ ID NO: 1295 - DNA, 25 bp, Artificial sequence
  Affy probe set ID: 226728_at
tctagcctgttgaatataccccacc

SEQ ID NO: 1296 - DNA, 25 bp, Artificial sequence
  Affy probe set ID: 226728_at
gaatataccccacctggtggtggcc

SEQ ID NO: 1297 - DNA, 25 bp, Artificial sequence
  Affy probe set ID: 226728_at
atggctctgacaccgtgttggtggc

SEQ ID NO: 1298 - DNA, 25 bp, Artificial sequence
  Affy probe set ID: 226728_at
tgttggtggcgatgtcccagacaat

SEQ ID NO: 1299 - DNA, 25 bp, Artificial sequence
  Affy probe set ID: 226728_at
ctggtggctcatctcgaacatccac

SEQ ID NO: 1300 - DNA, 25 bp, Artificial sequence
  Affy probe set ID: 226728_at
gagacaccgtggcgtctcatgtgaa

SEQ ID NO: 1301 - DNA, 25 bp, Artificial sequence
  Affy probe set ID: 226728_at
tcatgtgaactttcctgggcactgt

SEQ ID NO: 1302 - DNA, 337 bp, Artificial sequence
  Target_Sequence, Fragment of GenBank Accession No. NM_025106
  misc_feature (69)..(69): n is a, c, g, or t
  misc_feature (225)..(226): n is a, c, g, or t
ctgcacaggtacaatagatgactttatttgtttaaaatgtttaatatatatacatacatatatatatantttgtctgtaagaattatgttttaaacagctgctgtagagtacctttttttaagtaaatcttacagtggagtatattttttaaagcacaaaattggtgccaagactgggtgagaaatgtacattacccccttattattttgacggttttttttttnncggggcaggggaccttacctgtaagacttttaaagattttcctccctcctgtttcaggtgggtcacattctgatgaatgtttcccttgtacagatcccagcttatggcctt

SEQ ID NO: 1303 - DNA, 25 bp, Artificial sequence
  Affy probe set ID: 226075_at
ctgcacaggtacaatagatgacttt

SEQ ID NO: 1304 - DNA, 25 bp, Artificial sequence
  Affy probe set ID: 226075_at
acagctgctgtagagtacctttttt

SEQ ID NO: 1305 - DNA, 25 bp, Artificial sequence
  Affy probe set ID: 226075_at
tgctgtagagtacctttttttaagt

SEQ ID NO: 1306 - DNA, 25 bp, Artificial sequence
  Affy probe set ID: 226075_at
caagactgggtgagaaatgtacatt

SEQ ID NO: 1307 - DNA, 25 bp, Artificial sequence
  Affy probe set ID: 226075_at
gaaatgtacattacccccttattat

SEQ ID NO: 1308 - DNA, 25 bp, Artificial sequence
  Affy probe set ID: 226075_at
ctccctcctgtttcaggtgggtcac

SEQ ID NO: 1309 - DNA, 25 bp, Artificial sequence
  Affy probe set ID: 226075_at
gtttcaggtgggtcacattctgatg

SEQ ID NO: 1310 - DNA, 25 bp, Artificial sequence
  Affy probe set ID: 226075_at
attctgatgaatgtttcccttgtac

SEQ ID NO: 1311 - DNA, 25 bp, Artificial sequence
  Affy probe set ID: 226075_at
tgaatgtttcccttgtacagatccc

SEQ ID NO: 1312 - DNA, 25 bp, Artificial sequence
  Affy probe set ID: 226075_at
cccttgtacagatcccagcttatgg

SEQ ID NO: 1313 - DNA, 25 bp, Artificial sequence
  Affy probe set ID: 226075_at
tgtacagatcccagcttatggcctt

SEQ ID NO: 1314 - DNA, 433 bp, Artificial sequence
  Target_Sequence, Fragment of GenBank Accession No. NM_020130
gttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaagaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaa

SEQ ID NO: 1315 - DNA, 25 bp, Artificial sequence
  Affy probe set ID: 218541_s_at
gttcaaaatatttccaagcctgagt

SEQ ID NO: 1316 - DNA, 25 bp, Artificial sequence
  Affy probe set ID: 218541_s_at
aagcctgagtattgtctattggtat

SEQ ID NO: 1317 - DNA, 25 bp, Artificial sequence
  Affy probe set ID: 218541_s_at
ttgattatttatttgcacttattac

SEQ ID NO: 1318 - DNA, 25 bp, Artificial sequence
  Affy probe set ID: 218541_s_at
caatgcctgaaaaagtgcaccacat

SEQ ID NO: 1319 - DNA, 25 bp, Artificial sequence
  Affy probe set ID: 218541_s_at
aagtgcaccacatggatgttaagta

SEQ ID NO: 1320 - DNA, 25 bp, Artificial sequence
  Affy probe set ID: 218541_s_at
aagtaagatgtcttcagcaactcag

SEQ ID NO: 1321 - DNA, 25 bp, Artificial sequence
  Affy probe set ID: 218541_s_at
agtactgtgaaaacattttacatat

SEQ ID NO: 1322 - DNA, 25 bp, Artificial sequence
  Affy probe set ID: 218541_s_at
atcttctgactaatgctaaaacgta

SEQ ID NO: 1323 - DNA, 25 bp, Artificial sequence
  Affy probe set ID: 218541_s_at
gactaatgctaaaacgtaatctaat

SEQ ID NO: 1324 - DNA, 25 bp, Artificial sequence
  Affy probe set ID: 218541_s_at
gttactgcagtaagcattaggaagt

SEQ ID NO: 1325 - DNA, 25 bp, Artificial sequence
  Affy probe set ID: 218541_s_at
tttactggcaaatgtcatgcaacaa

SEQ ID NO: 1326 - DNA, 258 bp, Artificial sequence
  Target_Sequence, Fragment of GenBank Accession No. NM_173833
tcccaacccggttctggcaaagaatccagttatcccttccatgaagacgcacataactctcttacttggtctttccattagggacaacataagtcttgttttacatcaaataaaaacaatgttaaaaagtgtgtgaaccttaaaaatggaagtctactagtttacatacctacttcagaggacatggaaatgaccatgggcctgcatttcagggaccaaagcaaattaggcctggcctaaaatacatcagaccttttg

SEQ ID NO: 1327 - DNA, 25 bp, Artificial sequence
  Affy probe set ID: 229839_at
tcccaacccggttctggcaaagaat

SEQ ID NO: 1328 - DNA, 25 bp, Artificial sequence
  Affy probe set ID: 229839_at
ccttccatgaagacgcacataactc

SEQ ID NO: 1329 - DNA, 25 bp, Artificial sequence
  Affy probe set ID: 229839_at
acataactctcttacttggtctttc

SEQ ID NO: 1330 - DNA, 25 bp, Artificial sequence
  Affy probe set ID: 229839_at
cttggtctttccattagggacaaca

SEQ ID NO: 1331 - DNA, 25 bp, Artificial sequence
  Affy probe set ID: 229839_at
gggacaacataagtcttgttttaca

SEQ ID NO: 1332 - DNA, 25 bp, Artificial sequence
  Affy probe set ID: 229839_at
ggaagtctactagtttacataccta

SEQ ID NO: 1333 - DNA, 25 bp, Artificial sequence
  Affy probe set ID: 229839_at
gtttacatacctacttcagaggaca

SEQ ID NO: 1334 - DNA, 25 bp, Artificial sequence
  Affy probe set ID: 229839_at
atggaaatgaccatgggcctgcatt

SEQ ID NO: 1335 - DNA, 25 bp, Artificial sequence
  Affy probe set ID: 229839_at
gggcctgcatttcagggaccaaagc

SEQ ID NO: 1336 - DNA, 25 bp, Artificial sequence
  Affy probe set ID: 229839_at
ggaccaaagcaaattaggcctggcc

SEQ ID NO: 1337 - DNA, 25 bp, Artificial sequence
  Affy probe set ID: 229839_at
ggcctaaaatacatcagaccttttg

SEQ ID NO: 1338 - DNA, 523 bp, Artificial sequence
  Target_Sequence, Fragment of GenBank Accession No. NM_007223
  misc_feature (31)..(31): n is a, c, g, or t
  misc_feature (328)..(328): n is a, c, g, or t
agagtgttgtgttcttgctcttggtacttanaggagctagtctggtgccttgagcaagcttgaagggaagtgggtgtcctcaccagcaaacttccacatctcaactcgtgccctcttttggccacactggccccgtctcttggagggagcccagaccctgtagggagttttgttttcctttcttctcttgggtgtggtgtcttgtgtttctgaatgtgaacccaaagaccctacccctggagaggaagcaccttcctctttgtgttggtctcctcatagcactgtttgctcacagcagaaacggggctgccacagcctcctgcggctntgctgccttctgggccctgcgtgcatggcatctatagctccttgccctgatagtcaatgctgtggcccttcaagcttgtctttcaaagctttcacaatcattacaacttttatcaaggggaataataatctctaggaaaattatgtccactttaggagaatctgtcaagtgtagccactttggtgttgttctgat

SEQ ID NO: 1339 - DNA, 25 bp, Artificial sequence
  Affy probe set ID: 227846_at
agagtgttgtgttcttgctcttggt

SEQ ID NO: 1340 - DNA, 25 bp, Artificial sequence
  Affy probe set ID: 227846_at
gctagtctggtgccttgagcaagct

SEQ ID NO: 1341 - DNA, 25 bp, Artificial sequence
  Affy probe set ID: 227846_at
ggagcccagaccctgtagggagttt

SEQ ID NO: 1342 - DNA, 25 bp, Artificial sequence
  Affy probe set ID: 227846_at
cctttcttctcttgggtgtggtgtc

SEQ ID NO: 1343 - DNA, 25 bp, Artificial sequence
  Affy probe set ID: 227846_at
gtgtggtgtcttgtgtttctgaatg

SEQ ID NO: 1344 - DNA, 25 bp, Artificial sequence
  Affy probe set ID: 227846_at
tctttgtgttggtctcctcatagca

SEQ ID NO: 1345 - DNA, 25 bp, Artificial sequence
  Affy probe set ID: 227846_at
cctcatagcactgtttgctcacagc

SEQ ID NO: 1346 - DNA, 25 bp, Artificial sequence
  Affy probe set ID: 227846_at
gcatggcatctatagctccttgccc

SEQ ID NO: 1347 - DNA, 25 bp, Artificial sequence
  Affy probe set ID: 227846_at
ccctgatagtcaatgctgtggccct

SEQ ID NO: 1348 - DNA, 25 bp, Artificial sequence
  Affy probe set ID: 227846_at
ggagaatctgtcaagtgtagccact

SEQ ID NO: 1349 - DNA, 25 bp, Artificial sequence
  Affy probe set ID: 227846_at
gtagccactttggtgttgttctgat

SEQ ID NO: 1350 - DNA, 531 bp, Artificial sequence
  Target_Sequence, Fragment of GenBank Accession No. NM_013437
gtctttccctaatacagggttgcgcttgcattggaccctagggatttgcactaaaattatatcaaggtctcagatgagcttagtgcacaagcactatcactttaaatactattatttgctaccacagcaactatatatttccatagcttttggctgggggcgggggacatttttattacaacttgaaattgctttgctggtttcatatttatttgttgtatttaaaaaatacattgttgtaagagtgattttttcaatatattttattcctgggggggatcatgctacactctcaaaagaaaattaagaaatcattcagatcatcccccctttttaagtagtgtgaattgcaaaacccaacatatttttttttactgtcagttgcggtttatttattctttaactgtctgttttagtagtttaatgattatgaaaaatgtatctgtgtgtgatttgctatttattaaattttaagtactttgctgaatgtcattttaaagcatgtttgaagtcttgtgtatttgtctgtgt

SEQ ID NO: 1351 - DNA, 25 bp, Artificial sequence
  Affy probe set ID: 219631_at
gtctttccctaatacagggttgcgc

SEQ ID NO: 1352 - DNA, 25 bp, Artificial sequence
  Affy probe set ID: 219631_at
agggttgcgcttgcattggacccta

SEQ ID NO: 1353 - DNA, 25 bp, Artificial sequence
  Affy probe set ID: 219631_at
tggaccctagggatttgcactaaaa

SEQ ID NO: 1354 - DNA, 25 bp, Artificial sequence
  Affy probe set ID: 219631_at
gtctcagatgagcttagtgcacaag

SEQ ID NO: 1355 - DNA, 25 bp, Artificial sequence
  Affy probe set ID: 219631_at
gtgcacaagcactatcactttaaat

SEQ ID NO: 1356 - DNA, 25 bp, Artificial sequence
  Affy probe set ID: 219631_at
gctaccacagcaactatatatttcc

SEQ ID NO: 1357 - DNA, 25 bp, Artificial sequence
  Affy probe set ID: 219631_at
ttccatagcttttggctgggggcgg

SEQ ID NO: 1358 - DNA, 25 bp, Artificial sequence
  Affy probe set ID: 219631_at
attgctttgctggtttcatatttat

SEQ ID NO: 1359 - DNA, 25 bp, Artificial sequence
  Affy probe set ID: 219631_at
gtcagttgcggtttatttattcttt

SEQ ID NO: 1360 - DNA, 25 bp, Artificial sequence
  Affy probe set ID: 219631_at
tctgtgtgtgatttgctatttatta

SEQ ID NO: 1361 - DNA, 25 bp, Artificial sequence
  Affy probe set ID: 219631_at
tgaagtcttgtgtatttgtctgtgt

SEQ ID NO: 1362 - DNA, 467 bp, Artificial sequence
  Target_Sequence, Fragment of GenBank Accession No. NM_007332
  misc_feature (123)..(123): n is a, c, g, or t
gaaaaatgcttactcaattgctttgaaaaatgtttatccttttccacagaaattcaagatgtaaatacaacaaagccttgtcatattagctatcttttttcaaattagacagaaaaaaattcntgacactatttaatttcagtgctagtgagcagatgttttagggtgcaagagccatgttgctatttcagttatgatgtaattaagcaacaactgtctggcctgggtctacttcggtcccctttgcaggtcagttgcttggtgtttctttgtaaaccagaaaaaactgagcaaaacattcattcatgtagctgtagcaccaatttgctggcatcaatattatggtaaggaaatgtgtttttgaacattagcctaataagctctttgctactgctatggtaagatatcaaatgaaaaacctctgtaaaacatttccaggttttttctttcttatcacaatatcattt

SEQ ID NO: 1363 - DNA, 25 bp, Artificial sequence
  Affy probe set ID: 228438_at
gaaaaatgcttactcaattgctttg

SEQ ID NO: 1364 - DNA, 25 bp, Artificial sequence
  Affy probe set ID: 228438_at
tttatccttttccacagaaattcaa

SEQ ID NO: 1365 - DNA, 25 bp, Artificial sequence
  Affy probe set ID: 228438_at
acaacaaagccttgtcatattagct

SEQ ID NO: 1366 - DNA, 25 bp, Artificial sequence
  Affy probe set ID: 228438_at
ggtgcaagagccatgttgctatttc

SEQ ID NO: 1367 - DNA, 25 bp, Artificial sequence
  Affy probe set ID: 228438_at
taagcaacaactgtctggcctgggt

SEQ ID NO: 1368 - DNA, 25 bp, Artificial sequence
  Affy probe set ID: 228438_at
caggtcagttgcttggtgtttcttt

SEQ ID NO: 1369 - DNA, 25 bp, Artificial sequence
  Affy probe set ID: 228438_at
cattcattcatgtagctgtagcacc

SEQ ID NO: 1370 - DNA, 25 bp, Artificial sequence
  Affy probe set ID: 228438_at
gctgtagcaccaatttgctggcatc

SEQ ID NO: 1371 - DNA, 25 bp, Artificial sequence
  Affy probe set ID: 228438_at
aacattagcctaataagctctttgc

SEQ ID NO: 1372 - DNA, 25 bp, Artificial sequence
  Affy probe set ID: 228438_at
ataagctctttgctactgctatggt

SEQ ID NO: 1373 - DNA, 50 bp, Artificial sequence
  Affy probe set ID: 228438_at
tttctttcttatcacaatatcatttgaaaaatgcttactcaattgctttg

SEQ ID NO: 1374 - DNA, 429 bp, Artificial sequence
  Target_Sequence, Fragment of GenBank Accession No. NM_152744
  misc_feature (71)..(71): n is a, c, g, or t
  misc_feature (111)..(111): n is a, c, g, or t
  misc_feature (274)..(274): n is a, c, g, or t
gaaatgttctcacttggcagtgtctagtcaaggagtcggctttcaggttcctgacggccaggcagggatgnctaaggtgtggctcagccgtcactgtctgtgtcactgcantggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcntctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaa

SEQ ID NO: 1375 - DNA, 25 bp, Artificial sequence
  Affy probe set ID: 229912_at
gaaatgttctcacttggcagtgtct

SEQ ID NO: 1376 - DNA, 25 bp, Artificial sequence
  Affy probe set ID: 229912_at
ggcagtgtctagtcaaggagtcggc

SEQ ID NO: 1377 - DNA, 25 bp, Artificial sequence
  Affy probe set ID: 229912_at
caaggagtcggctttcaggttcctg

SEQ ID NO: 1378 - DNA, 25 bp, Artificial sequence
  Affy probe set ID: 229912_at
ctaaggtgtggctcagccgtcactg

SEQ ID NO: 1379 - DNA, 25 bp, Artificial sequence
  Affy probe set ID: 229912_at
ttctcacctgacagcgagggagagg

SEQ ID NO: 1380 - DNA, 25 bp, Artificial sequence
  Affy probe set ID: 229912_at
gggaagcctcttagggctggaagcc

SEQ ID NO: 1381 - DNA, 25 bp, Artificial sequence
  Affy probe set ID: 229912_at
cccgaacacagcacacggtcaactc

SEQ ID NO: 1382 - DNA, 25 bp, Artificial sequence
  Affy probe set ID: 229912_at
tctccagaattgcttgttacgtagg

SEQ ID NO: 1383 - DNA, 25 bp, Artificial sequence
  Affy probe set ID: 229912_at
aggaagcgtgcattgttaaccagag

SEQ ID NO: 1384 - DNA, 25 bp, Artificial sequence
  Affy probe set ID: 229912_at
gaaatgaatgcgtctttgctgtctc

SEQ ID NO: 1385 - DNA, 25 bp, Artificial sequence
  Affy probe set ID: 229912_at
aattgttcagctttgtacatgggaa

SEQ ID NO: 1386 - DNA, 509 bp, Artificial sequence
  Target_Sequence, Fragment of GenBank Accession No. NM_001409
tgctcttagagacgttctccagccagaagagaaagaagccaggagggtgctctgagatattcagtcaccacagttcccaaatggcctaggaattcagagagtcagaatatcaccattactccccaatgggaacccccgacagtctcagcatggtgtgagggtgtggacggggggcctggcaggtaccaatcactcatcccgctcagtgaagacacagtgttcagctacggaagccataaggcaggccgagcttctgcccatccggaggaaatctcagctatccaacggcggtcaggagcagaggaaaataaagcagaataactagaaaacacgctcacagatcctaatgttaacggttacaaatgacgacggaaaaacaaactcctgaccatatattatatagtttcaagcagcaagaaggaggatattgaacattctcaacacacataataaacgcttgagatgatgatatgctcattaccctgatttgatcactagacatcccatgt

SEQ ID NO: 1387 - DNA, 25 bp, Artificial sequence
  Affy probe set ID: 226869_at
tgctcttagagacgttctccagcca

SEQ ID NO: 1388 - DNA, 25 bp, Artificial sequence
  Affy probe set ID: 226869_at
tgagatattcagtcaccacagttcc

SEQ ID NO: 1389 - DNA, 25 bp, Artificial sequence
  Affy probe set ID: 226869_at
agtcagaatatcaccattactcccc

SEQ ID NO: 1390 - DNA, 25 bp, Artificial sequence
  Affy probe set ID: 226869_at
cccgacagtctcagcatggtgtgag

SEQ ID NO: 1391 - DNA, 25 bp, Artificial sequence
  Affy probe set ID: 226869_at
ctcatcccgctcagtgaagacacag

SEQ ID NO: 1392 - DNA, 25 bp, Artificial sequence
  Affy probe set ID: 226869_at
gacacagtgttcagctacggaagcc

SEQ ID NO: 1393 - DNA, 25 bp, Artificial sequence
  Affy probe set ID: 226869_at
ataaggcaggccgagcttctgccca

SEQ ID NO: 1394 - DNA, 25 bp, Artificial sequence
  Affy probe set ID: 226869_at
cttctgcccatccggaggaaatctc

SEQ ID NO: 1395 - DNA, 25 bp, Artificial sequence
  Affy probe set ID: 226869_at
tcagctatccaacggcggtcaggag

SEQ ID NO: 1396 - DNA, 25 bp, Artificial sequence
  Affy probe set ID: 226869_at
gaaaacacgctcacagatcctaatg

SEQ ID NO: 1397 - DNA, 25 bp, Artificial sequence
  Affy probe set ID: 226869_at
gatttgatcactagacatcccatgt

SEQ ID NO: 1398 - DNA, 443 bp, Artificial sequence
  Target_Sequence, Fragment of GenBank Accession No. NM_012082
atacacatgctataagttcgccttaagatttcaattcttggataatcaggctctgtttgcactttatattttagcagatacagtctcttagtcactaggctttgcatttgtatgtagctgtatgtttccgtccattttcttaatcctgaacctgtatgttaaatgaagatggcaatttttttcttgtatagtacttgtattttctttcgctgatgcagctctgtctcaatttttaaacctttgctgttaaatgcaatactttataaagaatgaacaaaattactggaagcagtattgtaagtaatgaggtagtattaatcagttttatcttttgaaaggcacagtctaaatcgaaaccctaaactcaatgctgcaagtatgaatttaattcatatataagatctatttaaatataagagtagcaatactgcacctggtgatca

SEQ ID NO: 1399 - DNA, 25 bp, Artificial sequence
  Affy probe set ID: 219778_at
atacacatgctataagttcgcctta

SEQ ID NO: 1400 - DNA, 25 bp, Artificial sequence
  Affy probe set ID: 219778_at
tggataatcaggctctgtttgcact

SEQ ID NO: 1401 - DNA, 25 bp, Artificial sequence
  Affy probe set ID: 219778_at
tagcagatacagtctcttagtcact

SEQ ID NO: 1402 - DNA, 25 bp, Artificial sequence
  Affy probe set ID: 219778_at
cttagtcactaggctttgcatttgt

SEQ ID NO: 1403 - DNA, 25 bp, Artificial sequence
  Affy probe set ID: 219778_at
gtatgtagctgtatgtttccgtcca

SEQ ID NO: 1404 - DNA, 25 bp, Artificial sequence
  Affy probe set ID: 219778_at
ttccgtccattttcttaatcctgaa

SEQ ID NO: 1405 - DNA, 25 bp, Artificial sequence
  Affy probe set ID: 219778_at
ttgtattttctttcgctgatgcagc

SEQ ID NO: 1406 - DNA, 25 bp, Artificial sequence
  Affy probe set ID: 219778_at
gatgcagctctgtctcaatttttaa

SEQ ID NO: 1407 - DNA, 25 bp, Artificial sequence
  Affy probe set ID: 219778_at
ggcacagtctaaatcgaaaccctaa

SEQ ID NO: 1408 - DNA, 25 bp, Artificial sequence
  Affy probe set ID: 219778_at
gaaaccctaaactcaatgctgcaag

SEQ ID NO: 1409 - DNA, 25 bp, Artificial sequence
  Affy probe set ID: 219778_at
gtagcaatactgcacctggtgatca

SEQ ID NO: 1410 - DNA, 426 bp, Artificial sequence
  Target_Sequence, Fragment of GenBank Accession No. NM_080430
  misc_feature (262)..(262): n is a, c, g, or t
  misc_feature (271)..(271): n is a, c, g, or t
gccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctancgcaaggcngcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatccc

SEQ ID NO: 1411 - DNA, 25 bp, Artificial sequence
  Affy probe set ID: 226051_at
gccggactggaaccgtctgagcggc

SEQ ID NO: 1412 - DNA, 25 bp, Artificial sequence
  Affy probe set ID: 226051_at
gggtagagacctgcgggggatgaca

SEQ ID NO: 1413 - DNA, 25 bp, Artificial sequence
  Affy probe set ID: 226051_at
gatgacagctgaaccgcctaaagga

SEQ ID NO: 1414 - DNA, 25 bp, Artificial sequence
  Affy probe set ID: 226051_at
aggaggtgaaggctttcgtcacgca

SEQ ID NO: 1415 - DNA, 25 bp, Artificial sequence
  Affy probe set ID: 226051_at
tcgtcacgcaggacattccattcta

SEQ ID NO: 1416 - DNA, 25 bp, Artificial sequence
  Affy probe set ID: 226051_at
cattccattctatcacaacctggtg

SEQ ID NO: 1417 - DNA, 25 bp, Artificial sequence
  Affy probe set ID: 226051_at
tacgaggaactagagcgcatcccac

SEQ ID NO: 1418 - DNA, 25 bp, Artificial sequence
  Affy probe set ID: 226051_at
tcccactcagtgaaatgacccgcga

SEQ ID NO: 1419 - DNA, 25 bp, Artificial sequence
  Affy probe set ID: 226051_at
aatgcgctagtgcaggagctcggct

SEQ ID NO: 1420 - DNA, 25 bp, Artificial sequence
  Affy probe set ID: 226051_at
ttcggaccacgctgacctgtaggtc

SEQ ID NO: 1421 - DNA, 25 bp, Artificial sequence
  Affy probe set ID: 226051_at
gacagaatgaagcgctcagcatccc

SEQ ID NO: 1422 - DNA, 260 bp, Artificial sequence
  Target_Sequence, Fragment of GenBank Accession No. NM_030971
cctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttca

SEQ ID NO: 1423 - DNA, 25 bp, Artificial sequence
  Affy probe set ID: 217226_s_at
cctgttccactgacatttcttagac

SEQ ID NO: 1424 - DNA, 25 bp, Artificial sequence
  Affy probe set ID: 217226_s_at
gttccactgacatttcttagacatt

SEQ ID NO: 1425 - DNA, 25 bp, Artificial sequence
  Affy probe set ID: 217226_s_at
tttcttagacattcagcaaaacccc

SEQ ID NO: 1426 - DNA, 25 bp, Artificial sequence
  Affy probe set ID: 217226_s_at
ttctttcttgagggttggtcctgtc

SEQ ID NO: 1427 - DNA, 25 bp, Artificial sequence
  Affy probe set ID: 217226_s_at
cgggcatcagtggctagtccaaata

SEQ ID NO: 1428 - DNA, 25 bp, Artificial sequence
  Affy probe set ID: 217226_s_at
aaaatatgggcttggggatggaatg

SEQ ID NO: 1429 - DNA, 25 bp, Artificial sequence
  Affy probe set ID: 217226_s_at
ggggatggaatgggtggtggtaagt

SEQ ID NO: 1430 - DNA, 25 bp, Artificial sequence
  Affy probe set ID: 217226_s_at
gggtggtggtaagttcacagagtgt

SEQ ID NO: 1431 - DNA, 25 bp, Artificial sequence
  Affy probe set ID: 217226_s_at
ttcacagagtgtagttagatcccaa

SEQ ID NO: 1432 - DNA, 25 bp, Artificial sequence
  Affy probe set ID: 217226_s_at
agtgtagttagatcccaactcccat

SEQ ID NO: 1433 - DNA, 25 bp, Artificial sequence
  Affy probe set ID: 217226_s_at
gggcagggcagatgaaagggcttca

SEQ ID NO: 1434 - DNA, 558 bp, Artificial sequence
  Target_Sequence, Fragment of GenBank Accession No. NM_003246
  misc_feature (124)..(124): n is a, c, g, or t
  misc_feature (422)..(422): n is a, c, g, or t
tcatgatgctgactggcgttagctgattaacccatgtaaataggcacttaaatagaagcaggaaagggagacaaagactggcttctggacttcctccctgatccccacccttactcatcacctngcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtangattttttttaaatgctttacgatgtaaaatatttattttttacttattctggaagatctggctgaaggattattcatggaacaggaagaagcgtaaagactatccatgtcatctttgttgagagtcttcgtgact

SEQ ID NO: 1435 - DNA, 25 bp, Artificial sequence
  Affy probe set ID: 201109_s_at
tcatgatgctgactggcgttagctg

SEQ ID NO: 1436 - DNA, 25 bp, Artificial sequence
  Affy probe set ID: 201109_s_at
ggcgttagctgattaacccatgtaa

SEQ ID NO: 1437 - DNA, 25 bp, Artificial sequence
  Affy probe set ID: 201109_s_at
gacaaagactggcttctggacttcc

SEQ ID NO: 1438 - DNA, 25 bp, Artificial sequence
  Affy probe set ID: 201109_s_at
tgccattgcctggtcacattgaaat

SEQ ID NO: 1439 - DNA, 25 bp, Artificial sequence
  Affy probe set ID: 201109_s_at
ggtggcttcattctagatgtagctt

SEQ ID NO: 1440 - DNA, 25 bp, Artificial sequence
  Affy probe set ID: 201109_s_at
taccatctcagtgagcaccagctgc

SEQ ID NO: 1441 - DNA, 25 bp, Artificial sequence
  Affy probe set ID: 201109_s_at
accagctgcctcccaaaggaggggc

SEQ ID NO: 1442 - DNA, 25 bp, Artificial sequence
  Affy probe set ID: 201109_s_at
aggggcagccgtgcttatattttta

SEQ ID NO: 1443 - DNA, 25 bp, Artificial sequence
  Affy probe set ID: 201109_s_at
tatcaacctaactaaaacattcctt

SEQ ID NO: 1444 - DNA, 25 bp, Artificial sequence
  Affy probe set ID: 201109_s_at
gcgtaaagactatccatgtcatctt

SEQ ID NO: 1445 - DNA, 25 bp, Artificial sequence
  Affy probe set ID: 201109_s_at
atctttgttgagagtcttcgtgact

SEQ ID NO: 1446 - DNA, 413 bp, Artificial sequence
  Target_Sequence, Fragment of GenBank Accession No. NM_003882
  misc_feature (385)..(385): n is a, c, g, or t
ttcactccatgaatgatctcttctgtaagtcagtgtgaatcatgttagattttctgagagtgaaaacacctgccatctacaaattacaaggctggataacagctcactccatttgaaattcagtggaaacccaagagctaggttcttactgaatttgcatctcaatttgggaaactgaacttagctttcaaagatcataggaagtctggttggagaaactagggattattctggcaatgggtggaggaaggtggtcagaataacccagtcgccattggttttgagaaacggaactatcttatgcagagcccggagggcaagtctcaaacccatgggttgaagccatggagaaggaaatttggatccaatgtaatgaagctctttntaagtcagaatttccctgcaatggtgtg

SEQ ID NO: 1447 - DNA, 25 bp, Artificial sequence
  Affy probe set ID: 235821_at
ttcactccatgaatgatctcttctg

SEQ ID NO: 1448 - DNA, 25 bp, Artificial sequence
  Affy probe set ID: 235821_at
gaaaacacctgccatctacaaatta

SEQ ID NO: 1449 - DNA, 25 bp, Artificial sequence
  Affy probe set ID: 235821_at
aaggctggataacagctcactccat

SEQ ID NO: 1450 - DNA, 25 bp, Artificial sequence
  Affy probe set ID: 235821_at
aacagctcactccatttgaaattca

SEQ ID NO: 1451 - DNA, 25 bp, Artificial sequence
  Affy probe set ID: 235821_at
gagctaggttcttactgaatttgca

SEQ ID NO: 1452 - DNA, 25 bp, Artificial sequence
  Affy probe set ID: 235821_at
actagggattattctggcaatgggt

SEQ ID NO: 1453 - DNA, 25 bp, Artificial sequence
  Affy probe set ID: 235821_at
gaataacccagtcgccattggtttt

SEQ ID NO: 1454 - DNA, 25 bp, Artificial sequence
  Affy probe set ID: 235821_at
gaactatcttatgcagagcccggag

SEQ ID NO: 1455 - DNA, 25 bp, Artificial sequence
  Affy probe set ID: 235821_at
gagcccggagggcaagtctcaaacc

SEQ ID NO: 1456 - DNA, 25 bp, Artificial sequence
  Affy probe set ID: 235821_at
ggcaagtctcaaacccatgggttga

SEQ ID NO: 1457 - DNA, 25 bp, Artificial sequence
  Affy probe set ID: 235821_at
gtcagaatttccctgcaatggtgtg

SEQ ID NO: 1458 - DNA, 544 bp, Artificial sequence
  Target_Sequence, Fragment of GenBank Accession No. NM_005202
  misc_feature (194)..(194): n is a, c, g, or t
  misc_feature (196)..(197): n is a, c, g, or t
  misc_feature (203)..(203): n is a, c, g, or t
gactggctgagcagtgggttccttcaggttccttgccaaccctcctcccctgcccacaacttctccaaacaaagcaggctgtttgctcacttcttcaaaaggaggaatgataacccaaatctgcccaagtgacacttgagaaggttttggctggggttcctggtggatttcttactacctaacgcccaagaaancnnactaangactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcattttt

SEQ ID NO: 1459 - DNA, 25 bp, Artificial sequence
  Affy probe set ID: 221900_at
gactggctgagcagtgggttccttc

SEQ ID NO: 1460 - DNA, 25 bp, Artificial sequence
  Affy probe set ID: 221900_at
aaagcaggctgtttgctcacttctt

SEQ ID NO: 1461 - DNA, 25 bp, Artificial sequence
  Affy probe set ID: 221900_at
tggatttcttactacctaacgccca

SEQ ID NO: 1462 - DNA, 25 bp, Artificial sequence
  Affy probe set ID: 221900_at
gactctcaaaccatacctggtgggg

SEQ ID NO: 1463 - DNA, 25 bp, Artificial sequence
  Affy probe set ID: 221900_at
ttcttccctaggtcaaagccactat

SEQ ID NO: 1464 - DNA, 25 bp, Artificial sequence
  Affy probe set ID: 221900_at
atgggagcccacggaactaagtagg

SEQ ID NO: 1465 - DNA, 25 bp, Artificial sequence
  Affy probe set ID: 221900_at
gagcttctgccaaatttcattcctc

SEQ ID NO: 1466 - DNA, 25 bp, Artificial sequence
  Affy probe set ID: 221900_at
tttcattcctcaaacctttcaggag

SEQ ID NO: 1467 - DNA, 25 bp, Artificial sequence
  Affy probe set ID: 221900_at
tcaggaggggtggttggcgtttcta

SEQ ID NO: 1468 - DNA, 25 bp, Artificial sequence
  Affy probe set ID: 221900_at
gcaggtgtccacttaactgactagc

SEQ ID NO: 1469 - DNA, 25 bp, Artificial sequence
  Affy probe set ID: 221900_at
aaacgacattaccttgtgcattttt

SEQ ID NO: 1470 - DNA, 253 bp, Artificial sequence
  Target_Sequence, Fragment of GenBank Accession No. NM_003711
aaggcaagaggatgcatctttcttcctggtgtacaagcctttaaagacttctgctgctgatatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttg

SEQ ID NO: 1471 - DNA, 25 bp, Artificial sequence
  Affy probe set ID: 210946_at
aaggcaagaggatgcatctttcttc

SEQ ID NO: 1472 - DNA, 25 bp, Artificial sequence
  Affy probe set ID: 210946_at
gcatctttcttcctggtgtacaagc

SEQ ID NO: 1473 - DNA, 25 bp, Artificial sequence
  Affy probe set ID: 210946_at
acaagcctttaaagacttctgctgc

SEQ ID NO: 1474 - DNA, 25 bp, Artificial sequence
  Affy probe set ID: 210946_at
gctgctgatatgcctcttggatgca

SEQ ID NO: 1475 - DNA, 25 bp, Artificial sequence
  Affy probe set ID: 210946_at
gatatgcctcttggatgcacacttt

SEQ ID NO: 1476 - DNA, 25 bp, Artificial sequence
  Affy probe set ID: 210946_at
gcctcttggatgcacactttgtgtg

SEQ ID NO: 1477 - DNA, 25 bp, Artificial sequence
  Affy probe set ID: 210946_at
actttgtgtgtacatagttaccttt

SEQ ID NO: 1478 - DNA, 25 bp, Artificial sequence
  Affy probe set ID: 210946_at
gttacctttaactcagtggttatct

SEQ ID NO: 1479 - DNA, 25 bp, Artificial sequence
  Affy probe set ID: 210946_at
gtggttatctaatagctctaaactc

SEQ ID NO: 1480 - DNA, 25 bp, Artificial sequence
  Affy probe set ID: 210946_at
aaaacagtgccccacctgtatacat

SEQ ID NO: 1481 - DNA, 25 bp, Artificial sequence
  Affy probe set ID: 210946_at
atatgctttctatgaatgatgtttg

SEQ ID NO: 1482 - DNA, 492 bp, Artificial sequence
  Target_Sequence, Fragment of GenBank Accession No. NM_004995
gggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccagtggcctgccctctcgctcccccacccagcccacccattgaagtctccttgggccaccaaaggtggtggccatggtaccggggacttgggagagtgagacccagtggagggagcaagaggagagggatgtcgggggggtggggcacggggtaggggaaatggggtgaacggtgctggcagttcggctagatttct

SEQ ID NO: 1483 - DNA, 25 bp, Artificial sequence
  Affy probe set ID: 202828_s_at
gggggccacagggtgggctgtggag

SEQ ID NO: 1484 - DNA, 25 bp, Artificial sequence
  Affy probe set ID: 202828_s_at
tgtggagctctcaggaagggccctg

SEQ ID NO: 1485 - DNA, 25 bp, Artificial sequence
  Affy probe set ID: 202828_s_at
ctgaggaaggcacacttgctcctgt

SEQ ID NO: 1486 - DNA, 25 bp, Artificial sequence
  Affy probe set ID: 202828_s_at
tgaggggcttcacgagaggccacag

SEQ ID NO: 1487 - DNA, 25 bp, Artificial sequence
  Affy probe set ID: 202828_s_at
gcctgctcaccatctcagtgagggg

SEQ ID NO: 1488 - DNA, 25 bp, Artificial sequence
  Affy probe set ID: 202828_s_at
cccacccattgaagtctccttgggc

SEQ ID NO: 1489 - DNA, 25 bp, Artificial sequence
  Affy probe set ID: 202828_s_at
gtctccttgggccaccaaaggtggt

SEQ ID NO: 1490 - DNA, 25 bp, Artificial sequence
  Affy probe set ID: 202828_s_at
tggccatggtaccggggacttggga

SEQ ID NO: 1491 - DNA, 25 bp, Artificial sequence
  Affy probe set ID: 202828_s_at
agaggagagggatgtcgggggggtg

SEQ ID NO: 1492 - DNA, 25 bp, Artificial sequence
  Affy probe set ID: 202828_s_at
gaaatggggtgaacggtgctggcag

SEQ ID NO: 1493 - DNA, 25 bp, Artificial sequence
  Affy probe set ID: 202828_s_at
gtgctggcagttcggctagatttct

SEQ ID NO: 1494 - DNA, 382 bp, Artificial sequence
  Target_Sequence, Fragment of GenBank Accession No. NM_001005336
ggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaa

SEQ ID NO: 1495 - DNA, 25 bp, Artificial sequence
  Affy probe set ID: 215116_s_at
ggtgagctgatacattcaggtgtga

SEQ ID NO: 1496 - DNA, 25 bp, Artificial sequence
  Affy probe set ID: 215116_s_at
tacattcaggtgtgaccgttggtga

SEQ ID NO: 1497 - DNA, 25 bp, Artificial sequence
  Affy probe set ID: 215116_s_at
tatacacacctacacatggccaacc

SEQ ID NO: 1498 - DNA, 25 bp, Artificial sequence
  Affy probe set ID: 215116_s_at
ctctagcgctgggaatcagtcactg

SEQ ID NO: 1499 - DNA, 25 bp, Artificial sequence
  Affy probe set ID: 215116_s_at
gctgggaatcagtcactgtgctatc

SEQ ID NO: 1500 - DNA, 25 bp, Artificial sequence
  Affy probe set ID: 215116_s_at
actgtgctatccttgtggagtcttg

SEQ ID NO: 1501 - DNA, 25 bp, Artificial sequence
  Affy probe set ID: 215116_s_at
tcttgtggcccaactaccagagaac

SEQ ID NO: 1502 - DNA, 25 bp, Artificial sequence
  Affy probe set ID: 215116_s_at
cccaactaccagagaacgctgtccc

SEQ ID NO: 1503 - DNA, 25 bp, Artificial sequence
  Affy probe set ID: 215116_s_at
ccaccccctaccaagcatgggggtg

SEQ ID NO: 1504 - DNA, 25 bp, Artificial sequence
  Affy probe set ID: 215116_s_at
accaagcatgggggtgctgtgcagg

SEQ ID NO: 1505 - DNA, 25 bp, Artificial sequence
  Affy probe set ID: 215116_s_at
tgctgtccctcggctgagaataaaa

SEQ ID NO: 1506 - DNA, 493 bp, Artificial sequence
  Target_Sequence, Fragment of GenBank Accession No. NM_153717
  misc_feature (463)..(463): n is a, c, g, or t
gagccgtgagccaagtaaacctctttaattacccagcctcaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccnggggttatgcaatgtggctgctttgactgt

SEQ ID NO: 1507 - DNA, 25 bp, Artificial sequence
  Affy probe set ID: 219432_at
gagccgtgagccaagtaaacctctt

SEQ ID NO: 1508 - DNA, 25 bp, Artificial sequence
  Affy probe set ID: 219432_at
gccttccgcggaatgaagcggccca

SEQ ID NO: 1509 - DNA, 25 bp, Artificial sequence
  Affy probe set ID: 219432_at
gcccttgttgacgttgatgtttccg

SEQ ID NO: 1510 - DNA, 25 bp, Artificial sequence
  Affy probe set ID: 219432_at
tcttcaaagacgatcttgccctggc

SEQ ID NO: 1511 - DNA, 25 bp, Artificial sequence
  Affy probe set ID: 219432_at
gccctggctgatgaccactagtggg

SEQ ID NO: 1512 - DNA, 25 bp, Artificial sequence
  Affy probe set ID: 219432_at
tgccccaaacgagctgttcataaca

SEQ ID NO: 1513 - DNA, 25 bp, Artificial sequence
  Affy probe set ID: 219432_at
aacagcgattttgcctaacattata

SEQ ID NO: 1514 - DNA, 25 bp, Artificial sequence
  Affy probe set ID: 219432_at
ataaccaacaactcaccgttgcgca

SEQ ID NO: 1515 - DNA, 25 bp, Artificial sequence
  Affy probe set ID: 219432_at
accgttgcgcatgtaggctgccggt

SEQ ID NO: 1516 - DNA, 25 bp, Artificial sequence
  Affy probe set ID: 219432_at
gctgccggtggctttctataatcaa

SEQ ID NO: 1517 - DNA, 25 bp, Artificial sequence
  Affy probe set ID: 219432_at
tatgcaatgtggctgctttgactgt

SEQ ID NO: 1518 - DNA, 303 bp, Artificial sequence
  Target_Sequence, Fragment of GenBank Accession No. NM_173462
atctctcaggacttctaattccttgatgctaaaagaagaggcatggattctatgagcttccaagtccctttccactttaaccttctacaaatctttcagaggactgcctagtagcaaaggttattcctggacacaggaaagacgggcattacagggaccaaagctctgaaaggtgacttttattaccaacacactggctggaaaagggacaaaccacatcacgggtgagtgatacttctcagtcttctctactcattcaacaaaggaaatgtgggctggggcagaggtcttttttcatttaat

SEQ ID NO: 1519 - DNA, 25 bp, Artificial sequence
  Affy probe set ID: 226435_at
atctctcaggacttctaattccttg

SEQ ID NO: 1520 - DNA, 25 bp, Artificial sequence
  Affy probe set ID: 226435_at
agaggcatggattctatgagcttcc

SEQ ID NO: 1521 - DNA, 25 bp, Artificial sequence
  Affy probe set ID: 226435_at
ttccactttaaccttctacaaatct

SEQ ID NO: 1522 - DNA, 25 bp, Artificial sequence
  Affy probe set ID: 226435_at
ttcagaggactgcctagtagcaaag

SEQ ID NO: 1523 - DNA, 25 bp, Artificial sequence
  Affy probe set ID: 226435_at
gtagcaaaggttattcctggacaca

SEQ ID NO: 1524 - DNA, 25 bp, Artificial sequence
  Affy probe set ID: 226435_at
ggacacaggaaagacgggcattaca

SEQ ID NO: 1525 - DNA, 25 bp, Artificial sequence
  Affy probe set ID: 226435_at
cgggcattacagggaccaaagctct

SEQ ID NO: 1526 - DNA, 25 bp, Artificial sequence
  Affy probe set ID: 226435_at
ggacaaaccacatcacgggtgagtg

SEQ ID NO: 1527 - DNA, 25 bp, Artificial sequence
  Affy probe set ID: 226435_at
acgggtgagtgatacttctcagtct

SEQ ID NO: 1528 - DNA, 25 bp, Artificial sequence
  Affy probe set ID: 226435_at
cagtcttctctactcattcaacaaa

SEQ ID NO: 1529 - DNA, 25 bp, Artificial sequence
  Affy probe set ID: 226435_at
gggcagaggtcttttttcatttaat

SEQ ID NO: 1530 - DNA, 569 bp, Artificial sequence
  Target_Sequence, Fragment of GenBank Accession No. XM_496707
caacccaaagtctgaatttcttgaggaaaaggtcaatgtcttttcatctctgtattgttccccacctcttaacacagtgcctggcacatactaggtgctcaataaatgtctgttgaatagaattattaataatttaagagtaggaaaaaggagtgtcagagagagactcaaagatgagtgagagagcatggaagatggctgtttcatgtgagacaggaatggaagaagttatgaatagggatcagatgggggagtgagaatccctgtaagtaaaatgtgaggaaaagaacaagctgagaacaagattctcctgtcaaaaaggcgtcttactgtaaatagtccaaggtgacatttgttagttttgaatactgcttttgggtttctttttttcatttttatattttaaaatttttatcaaagaacaaagacttatgtagttttcttttattctacacaatccaaattaaacagcttttggtgatgcaattgtacactttcttaagaatatatctaataccacattttagcagaaccaagcaatgactgacattattcattgggatctggcc

SEQ ID NO: 1531 - DNA, 25 bp, Artificial sequence
  Affy probe set ID: 229623_at
caacccaaagtctgaatttcttgag

SEQ ID NO: 1532 - DNA, 25 bp, Artificial sequence
  Affy probe set ID: 229623_at
ggaagatggctgtttcatgtgagac

SEQ ID NO: 1533 - DNA, 25 bp, Artificial sequence
  Affy probe set ID: 229623_at
gatgggggagtgagaatccctgtaa

SEQ ID NO: 1534 - DNA, 25 bp, Artificial sequence
  Affy probe set ID: 229623_at
tctcctgtcaaaaaggcgtcttact

SEQ ID NO: 1535 - DNA, 25 bp, Artificial sequence
  Affy probe set ID: 229623_at
ggcgtcttactgtaaatagtccaag

SEQ ID NO: 1536 - DNA, 25 bp, Artificial sequence
  Affy probe set ID: 229623_at
atagtccaaggtgacatttgttagt

SEQ ID NO: 1537 - DNA, 25 bp, Artificial sequence
  Affy probe set ID: 229623_at
gttagttttgaatactgcttttggg

SEQ ID NO: 1538 - DNA, 25 bp, Artificial sequence
  Affy probe set ID: 229623_at
ttttcttttattctacacaatccaa

SEQ ID NO: 1539 - DNA, 25 bp, Artificial sequence
  Affy probe set ID: 229623_at
ggtgatgcaattgtacactttctta

SEQ ID NO: 1540 - DNA, 25 bp, Artificial sequence
  Affy probe set ID: 229623_at
aataccacattttagcagaaccaag

SEQ ID NO: 1541 - DNA, 25 bp, Artificial sequence
  Affy probe set ID: 229623_at
tgacattattcattgggatctggcc

SEQ ID NO: 1542 - DNA, 298 bp, Artificial sequence
  Target_Sequence, Fragment of GenBank Accession No. NM_001839
aactctacattgatacattggcacaaacaggaagagcaaatgcatcacccaggcctaaatgtccacaggccacttttgtacatgctcttttagaaacaccactctgaaaagatcttgttcgctaggtaagagaatgagtacacatataatcacaaatgcacactgatcatgactttatttaaaaattagcaaacaatactgtagaaacattgatatgtaaatttctaaaatgctgcatcttaaatttagttggcaaagaccacatttagcaataagcatgagtttagtcttccatgta

SEQ ID NO: 1543 - DNA, 25 bp, Artificial sequence
  Affy probe set ID: 228297_at
aactctacattgatacattggcaca

SEQ ID NO: 1544 - DNA, 25 bp, Artificial sequence
  Affy probe set ID: 228297_at
gaagagcaaatgcatcacccaggcc

SEQ ID NO: 1545 - DNA, 25 bp, Artificial sequence
  Affy probe set ID: 228297_at
cacccaggcctaaatgtccacaggc

SEQ ID NO: 1546 - DNA, 25 bp, Artificial sequence
  Affy probe set ID: 228297_at
tgtccacaggccacttttgtacatg

SEQ ID NO: 1547 - DNA, 25 bp, Artificial sequence
  Affy probe set ID: 228297_at
gccacttttgtacatgctcttttag

SEQ ID NO: 1548 - DNA, 25 bp, Artificial sequence
  Affy probe set ID: 228297_at
gaaacaccactctgaaaagatcttg

SEQ ID NO: 1549 - DNA, 25 bp, Artificial sequence
  Affy probe set ID: 228297_at
gaaaagatcttgttcgctaggtaag

SEQ ID NO: 1550 - DNA, 25 bp, Artificial sequence
  Affy probe set ID: 228297_at
tgcacactgatcatgactttattta

SEQ ID NO: 1551 - DNA, 25 bp, Artificial sequence
  Affy probe set ID: 228297_at
atgctgcatcttaaatttagttggc

SEQ ID NO: 1552 - DNA, 25 bp, Artificial sequence
  Affy probe set ID: 228297_at
gttggcaaagaccacatttagcaat

SEQ ID NO: 1553 - DNA, 25 bp, Artificial sequence
  Affy probe set ID: 228297_at
aagcatgagtttagtcttccatgta

SEQ ID NO: 1554 - DNA, 423 bp, Artificial sequence
  Target_Sequence, Fragment of GenBank Accession No. NM_015429
agatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacat

SEQ ID NO: 1555 - DNA, 25 bp, Artificial sequence
  Affy probe set ID: 223395_at
agatacatttttacccaccataaat

SEQ ID NO: 1556 - DNA, 25 bp, Artificial sequence
  Affy probe set ID: 223395_at
aaactatccctttatgcaatcgtct

SEQ ID NO: 1557 - DNA, 25 bp, Artificial sequence
  Affy probe set ID: 223395_at
gcaatcgtcttcatattgtttttat

SEQ ID NO: 1558 - DNA, 25 bp, Artificial sequence
  Affy probe set ID: 223395_at
gcacgatgagattgcctaccatttt

SEQ ID NO: 1559 - DNA, 25 bp, Artificial sequence
  Affy probe set ID: 223395_at
gtatttatacgttaagacctctatg

SEQ ID NO: 1560 - DNA, 25 bp, Artificial sequence
  Affy probe set ID: 223395_at
ggtattgtcctttaggcggggaatg

SEQ ID NO: 1561 - DNA, 25 bp, Artificial sequence
  Affy probe set ID: 223395_at
gggaatgggaatccttgctgcactg

SEQ ID NO: 1562 - DNA, 25 bp, Artificial sequence
  Affy probe set ID: 223395_at
atccttgctgcactgttgcagtcat

SEQ ID NO: 1563 - DNA, 25 bp, Artificial sequence
  Affy probe set ID: 223395_at
gcagtcattctgaaaggacctttcc

SEQ ID NO: 1564 - DNA, 25 bp, Artificial sequence
  Affy probe set ID: 223395_at
cttacctttcaacatgcttcaatct

SEQ ID NO: 1565 - DNA, 25 bp, Artificial sequence
  Affy probe set ID: 223395_at
tgcttcaatcttatcaacgctacat

SEQ ID NO: 1566 - DNA, 378 bp, Artificial sequence
  Target_Sequence, Fragment of GenBank Accession No. NM_002840
ccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgtt

SEQ ID NO: 1567 - DNA, 25 bp, Artificial sequence
  Affy probe set ID: 200636_s_at
ccctggtttgcagctgttttcaaag

SEQ ID NO: 1568 - DNA, 25 bp, Artificial sequence
  Affy probe set ID: 200636_s_at
ttcaaagcccccgataatcgctctt

SEQ ID NO: 1569 - DNA, 25 bp, Artificial sequence
  Affy probe set ID: 200636_s_at
aagatgccctcataaaccaatgtgg

SEQ ID NO: 1570 - DNA, 25 bp, Artificial sequence
  Affy probe set ID: 200636_s_at
gtggcaagactactggacttctatc

SEQ ID NO: 1571 - DNA, 25 bp, Artificial sequence
  Affy probe set ID: 200636_s_at
gacttctatcaatggtactctaatc

SEQ ID NO: 1572 - DNA, 25 bp, Artificial sequence
  Affy probe set ID: 200636_s_at
taatcagtccttattatcccagctt

SEQ ID NO: 1573 - DNA, 25 bp, Artificial sequence
  Affy probe set ID: 200636_s_at
tatcccagcttgctgaggggcaggg

SEQ ID NO: 1574 - DNA, 25 bp, Artificial sequence
  Affy probe set ID: 200636_s_at
ctctgggcagcgctatctagatagg

SEQ ID NO: 1575 - DNA, 25 bp, Artificial sequence
  Affy probe set ID: 200636_s_at
cgtccccaaacctagctaggctaag

SEQ ID NO: 1576 - DNA, 25 bp, Artificial sequence
  Affy probe set ID: 200636_s_at
gaaacattcatttttaccttgtgga

SEQ ID NO: 1577 - DNA, 25 bp, Artificial sequence
  Affy probe set ID: 200636_s_at
gtacacagtctgttttctatttgtt

SEQ ID NO: 1578 - DNA, 235 bp, Artificial sequence
  Target_Sequence, Fragment of GenBank Accession No. NM_001001522
ctccttcctgcgagccctgaggaagccttctttccccagacatggccaacaagggtccttcctatggcatgagccgcgaagtgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcat

SEQ ID NO: 1579 - DNA, 25 bp, Artificial sequence
  Affy probe set ID: 1555724_s_at
ctccttcctgcgagccctgaggaag

SEQ ID NO: 1580 - DNA, 25 bp, Artificial sequence
  Affy probe set ID: 1555724_s_at
catggccaacaagggtccttcctat

SEQ ID NO: 1581 - DNA, 25 bp, Artificial sequence
  Affy probe set ID: 1555724_s_at
acaagggtccttcctatggcatgag

SEQ ID NO: 1582 - DNA, 25 bp, Artificial sequence
  Affy probe set ID: 1555724_s_at
agggtccttcctatggcatgagccg

SEQ ID NO: 1583 - DNA, 25 bp, Artificial sequence
  Affy probe set ID: 1555724_s_at
tccttcctatggcatgagccgcgaa

SEQ ID NO: 1584 - DNA, 25 bp, Artificial sequence
  Affy probe set ID: 1555724_s_at
cctatggcatgagccgcgaagtgca

SEQ ID NO: 1585 - DNA, 25 bp, Artificial sequence
  Affy probe set ID: 1555724_s_at
tgtggtaccttcagccctggccaag

SEQ ID NO: 1586 - DNA, 25 bp, Artificial sequence
  Affy probe set ID: 1555724_s_at
tggccaagctttgaggctctgtcac

SEQ ID NO: 1587 - DNA, 25 bp, Artificial sequence
  Affy probe set ID: 1555724_s_at
tgaggctctgtcactgagcaatggt

SEQ ID NO: 1588 - DNA, 25 bp, Artificial sequence
  Affy probe set ID: 1555724_s_at
gagcaatggtaactgcacctgggca

SEQ ID NO: 1589 - DNA, 25 bp, Artificial sequence
  Affy probe set ID: 1555724_s_at
agcccaacttcttacccgaaagcat

SEQ ID NO: 1590 - DNA, 501 bp, Artificial sequence
  Target_Sequence, Fragment of GenBank Accession No. NM_017637
attggactcagcctccatatttgacagcaaaagtggccagagggagttgaaatatcttgaagaaaaggaattttcactaagatatgtcctctccctctcccagagtttagctgtttattccttttttttgtttatattgttctcatctgcataaaaccagtctcttgcaataagcctgccgcagaatcaaagtctgtacttcaaaaggtaactgcaccaagggatgggacagtgtgcatcaccctgatctaatcattgtgacgttggtagcttcctaaatactgtatgtaccttgaacaagggttttatttttgttttgttctgttttgctttttgtttttattggtaggctaaggtaattaaattttttaatttgctgttactttggttgtattttctgtactataactgcctacagtatgtcttttgcataaaatgcataagggtttggggatgtaaatggaattttattcatattttgtccaaatacctcttgtaatt

SEQ ID NO: 1591 - DNA, 25 bp, Artificial sequence
  Affy probe set ID: 229942_at
attggactcagcctccatatttgac

SEQ ID NO: 1592 - DNA, 25 bp, Artificial sequence
  Affy probe set ID: 229942_at
attttcactaagatatgtcctctcc

SEQ ID NO: 1593 - DNA, 25 bp, Artificial sequence
  Affy probe set ID: 229942_at
ccctctcccagagtttagctgttta

SEQ ID NO: 1594 - DNA, 25 bp, Artificial sequence
  Affy probe set ID: 229942_at
ttgtttatattgttctcatctgcat

SEQ ID NO: 1595 - DNA, 25 bp, Artificial sequence
  Affy probe set ID: 229942_at
cagtctcttgcaataagcctgccgc

SEQ ID NO: 1596 - DNA, 25 bp, Artificial sequence
  Affy probe set ID: 229942_at
agcctgccgcagaatcaaagtctgt

SEQ ID NO: 1597 - DNA, 25 bp, Artificial sequence
  Affy probe set ID: 229942_at
ggtaactgcaccaagggatgggaca

SEQ ID NO: 1598 - DNA, 25 bp, Artificial sequence
  Affy probe set ID: 229942_at
atcattgtgacgttggtagcttcct

SEQ ID NO: 1599 - DNA, 25 bp, Artificial sequence
  Affy probe set ID: 229942_at
gtattttctgtactataactgccta

SEQ ID NO: 1600 - DNA, 25 bp, Artificial sequence
  Affy probe set ID: 229942_at
aactgcctacagtatgtcttttgca

SEQ ID NO: 1601 - DNA, 25 bp, Artificial sequence
  Affy probe set ID: 229942_at
ttttgtccaaatacctcttgtaatt

SEQ ID NO: 1602 - DNA, 466 bp, Artificial sequence
  Target_Sequence, Fragment of GenBank Accession No. NM_003391
tcaaaggagctttctcaatgtcttcccacaaatggtcccaattaagaaattccatacttctctcagatggaacagtaaagaaagcagaatcaactgcccctgacttaactttaacttttgaaaagaccaagacttttgtctgtacaagtggttttacagctaccacccttagggtaattggtaattacctggagaagaatggctttcaatacccttttaagtttaaaatgtgtatttttcaaggcatttattgccatattaaaatctgatgtaacaaggtggggacgtgtgtcctttggtactatggtgtgttgtatctttgtaagagcaaaagcctcagaaagggattgctttgcattactgtccccttgatataaaaaatctttagggaatgagagttccttctcacttagaatctgaagggaattaaaaagaagatgaatggtctggcaatattctgtaacta

SEQ ID NO: 1603 - DNA, 25 bp, Artificial sequence
  Affy probe set ID: 205648_at
tcaaaggagctttctcaatgtcttc

SEQ ID NO: 1604 - DNA, 25 bp, Artificial sequence
  Affy probe set ID: 205648_at
gtcttcccacaaatggtcccaatta

SEQ ID NO: 1605 - DNA, 25 bp, Artificial sequence
  Affy probe set ID: 205648_at
aagcagaatcaactgcccctgactt

SEQ ID NO: 1606 - DNA, 25 bp, Artificial sequence
  Affy probe set ID: 205648_at
gtggttttacagctaccacccttag

SEQ ID NO: 1607 - DNA, 25 bp, Artificial sequence
  Affy probe set ID: 205648_at
gaatggctttcaatacccttttaag

SEQ ID NO: 1608 - DNA, 25 bp, Artificial sequence
  Affy probe set ID: 205648_at
caaggtggggacgtgtgtcctttgg

SEQ ID NO: 1609 - DNA, 25 bp, Artificial sequence
  Affy probe set ID: 205648_at
gtgtcctttggtactatggtgtgtt

SEQ ID NO: 1610 - DNA, 25 bp, Artificial sequence
  Affy probe set ID: 205648_at
gggattgctttgcattactgtcccc

SEQ ID NO: 1611 - DNA, 25 bp, Artificial sequence
  Affy probe set ID: 205648_at
tgcattactgtccccttgatataaa

SEQ ID NO: 1612 - DNA, 25 bp, Artificial sequence
  Affy probe set ID: 205648_at
gagagttccttctcacttagaatct

SEQ ID NO: 1613 - DNA, 25 bp, Artificial sequence
  Affy probe set ID: 205648_at
atggtctggcaatattctgtaacta

SEQ ID NO: 1614 - DNA, 374 bp, Artificial sequence
  Target_Sequence, Fragment of GenBank Accession No. NM_015461
gactatggttggacttccttttctttacacttaagcctagaatttctctttaggtatatcagcgcttaaatccaagactattttttattgctgaagattcttgcaaaccatgaagagatgttctcacagaacagaaccccacagctggataaggcccgtatatatatatttgtaagccttgcaatgtgacaggtagcatcactatatatgcaatagttgttatgtagactgtcaaagaatttttttttccctggatacatttgaagctttgagtgttcaaggttttccttaatgatttcacgcagccaaattcttgaatcagttgaactaacctgtatgttactgttattaatgtttactctgcagtctgaacc

SEQ ID NO: 1615 - DNA, 25 bp, Artificial sequence
  Affy probe set ID: 226677_at
gactatggttggacttccttttctt

SEQ ID NO: 1616 - DNA, 25 bp, Artificial sequence
  Affy probe set ID: 226677_at
ttacacttaagcctagaatttctct

SEQ ID NO: 1617 - DNA, 25 bp, Artificial sequence
  Affy probe set ID: 226677_at
atttctctttaggtatatcagcgct

SEQ ID NO: 1618 - DNA, 25 bp, Artificial sequence
  Affy probe set ID: 226677_at
atcagcgcttaaatccaagactatt

SEQ ID NO: 1619 - DNA, 25 bp, Artificial sequence
  Affy probe set ID: 226677_at
gctgaagattcttgcaaaccatgaa

SEQ ID NO: 1620 - DNA, 25 bp, Artificial sequence
  Affy probe set ID: 226677_at
ttctcacagaacagaaccccacagc

SEQ ID NO: 1621 - DNA, 25 bp, Artificial sequence
  Affy probe set ID: 226677_at
agaaccccacagctggataaggccc

SEQ ID NO: 1622 - DNA, 25 bp, Artificial sequence
  Affy probe set ID: 226677_at
taagccttgcaatgtgacaggtagc

SEQ ID NO: 1623 - DNA, 25 bp, Artificial sequence
  Affy probe set ID: 226677_at
aggttttccttaatgatttcacgca

SEQ ID NO: 1624 - DNA, 25 bp, Artificial sequence
  Affy probe set ID: 226677_at
tcacgcagccaaattcttgaatcag

SEQ ID NO: 1625 - DNA, 25 bp, Artificial sequence
  Affy probe set ID: 226677_at
taatgtttactctgcagtctgaacc

SEQ ID NO: 1626 - DNA, 413 bp, Artificial sequence
  Target_Sequence, Fragment of GenBank Accession No. NM_006475
aaattgtggagttagcctcctgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgc

SEQ ID NO: 1627 - DNA, 25 bp, Artificial sequence
  Affy probe set ID: 210809_s_at
aaattgtggagttagcctcctgtgg

SEQ ID NO: 1628 - DNA, 25 bp, Artificial sequence
  Affy probe set ID: 210809_s_at
gtggagttagcctcctgtggtaaag

SEQ ID NO: 1629 - DNA, 25 bp, Artificial sequence
  Affy probe set ID: 210809_s_at
ttacaccctttttcatcttgacatt

SEQ ID NO: 1630 - DNA, 25 bp, Artificial sequence
  Affy probe set ID: 210809_s_at
gttctggctaactttggaatccatt

SEQ ID NO: 1631 - DNA, 25 bp, Artificial sequence
  Affy probe set ID: 210809_s_at
agagttgtgaactgttatcccattg

SEQ ID NO: 1632 - DNA, 25 bp, Artificial sequence
  Affy probe set ID: 210809_s_at
ttatcccattgaaaagaccgagcct

SEQ ID NO: 1633 - DNA, 25 bp, Artificial sequence
  Affy probe set ID: 210809_s_at
gaccgagccttgtatgtatgttatg

SEQ ID NO: 1634 - DNA, 25 bp, Artificial sequence
  Affy probe set ID: 210809_s_at
aaatgcacgcaagccattatctctc

SEQ ID NO: 1635 - DNA, 25 bp, Artificial sequence
  Affy probe set ID: 210809_s_at
agccattatctctccatgggaagct

SEQ ID NO: 1636 - DNA, 25 bp, Artificial sequence
  Affy probe set ID: 210809_s_at
aggctttgcacatttctatatgagt

SEQ ID NO: 1637 - DNA, 25 bp, Artificial sequence
  Affy probe set ID: 210809_s_at
gtttgtcatatgcttcttgcaatgc

SEQ ID NO: 1638 - DNA, 489 bp, Artificial sequence
  Target_Sequence, Fragment of GenBank Accession No. NM_005418
gtatattcccaaggggccgggtgctttcctgtcctgccagagcatggatgaagtttcgctgggtgctcgtgactggccagttttgtgcagctgactgtctcagccaaaccactgatcttccctggaggccttcggcctgcctgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttgtca

SEQ ID NO: 1639 - DNA, 25 bp, Artificial sequence
  Affy probe set ID: 202440_s_at
gtatattcccaaggggccgggtgct

SEQ ID NO: 1640 - DNA, 25 bp, Artificial sequence
  Affy probe set ID: 202440_s_at
tggatgaagtttcgctgggtgctcg

SEQ ID NO: 1641 - DNA, 25 bp, Artificial sequence
  Affy probe set ID: 202440_s_at
gctcgtgactggccagttttgtgca

SEQ ID NO: 1642 - DNA, 25 bp, Artificial sequence
  Affy probe set ID: 202440_s_at
tttgtgcagctgactgtctcagcca

SEQ ID NO: 1643 - DNA, 25 bp, Artificial sequence
  Affy probe set ID: 202440_s_at
gagcagatgctgtcttgttatgtac

SEQ ID NO: 1644 - DNA, 25 bp, Artificial sequence
  Affy probe set ID: 202440_s_at
tttgctggtagtccgcatacccata

SEQ ID NO: 1645 - DNA, 25 bp, Artificial sequence
  Affy probe set ID: 202440_s_at
ccaatcagtccccatttgtagcatg

SEQ ID NO: 1646 - DNA, 25 bp, Artificial sequence
  Affy probe set ID: 202440_s_at
ccaccctccgagatggtcagtgtgt

SEQ ID NO: 1647 - DNA, 25 bp, Artificial sequence
  Affy probe set ID: 202440_s_at
gtcagtgtgtcatgggaagcccacc

SEQ ID NO: 1648 - DNA, 25 bp, Artificial sequence
  Affy probe set ID: 202440_s_at
tggtggccacgatgcggtacagggc

SEQ ID NO: 1649 - DNA, 25 bp, Artificial sequence
  Affy probe set ID: 202440_s_at
tccttcccatctacgggtgttgtca

SEQ ID NO: 1650 - DNA, 273 bp, Artificial sequence
  Target_Sequence, Fragment of GenBank Accession No. NM_005203
aagtgatgcctctaaccttggattggcctgtgtgtgtgtttgtacatagaatatttatttttatacagttttcactttttgaaaatgccagaagtatgatgcatcttacagattattaaaaaagaaagaaaaaccgttgcatattttgtacagaaaatatcaacctcttcccttttgtttacaagatgttttgtataagcctatgtctctaatacattttttgtttggtcgtaatgtctgcatgatatttgtgcacatttattaagtatcgaa

SEQ ID NO: 1651 - DNA, 25 bp, Artificial sequence
  Affy probe set ID: 211343_s_at
aagtgatgcctctaaccttggattg

SEQ ID NO: 1652 - DNA, 25 bp, Artificial sequence
  Affy probe set ID: 211343_s_at
gatgcctctaaccttggattggcct

SEQ ID NO: 1653 - DNA, 25 bp, Artificial sequence
  Affy probe set ID: 211343_s_at
taaccttggattggcctgtgtgtgt

SEQ ID NO: 1654 - DNA, 25 bp, Artificial sequence
  Affy probe set ID: 211343_s_at
gccagaagtatgatgcatcttacag

SEQ ID NO: 1655 - DNA, 25 bp, Artificial sequence
  Affy probe set ID: 211343_s_at
gtatgatgcatcttacagattatta

SEQ ID NO: 1656 - DNA, 25 bp, Artificial sequence
  Affy probe set ID: 211343_s_at
gatgttttgtataagcctatgtctc

SEQ ID NO: 1657 - DNA, 25 bp, Artificial sequence
  Affy probe set ID: 211343_s_at
gtataagcctatgtctctaatacat

SEQ ID NO: 1658 - DNA, 25 bp, Artificial sequence
  Affy probe set ID: 211343_s_at
ttttttgtttggtcgtaatgtctgc

SEQ ID NO: 1659 - DNA, 25 bp, Artificial sequence
  Affy probe set ID: 211343_s_at
gtttggtcgtaatgtctgcatgata

SEQ ID NO: 1660 - DNA, 25 bp, Artificial sequence
  Affy probe set ID: 211343_s_at
atgtctgcatgatatttgtgcacat

SEQ ID NO: 1661 - DNA, 25 bp, Artificial sequence
  Affy probe set ID: 211343_s_at
ttgtgcacatttattaagtatcgaa

SEQ ID NO: 1662 - DNA, 477 bp, Artificial sequence
  Target_Sequence, Fragment of GenBank Accession No. NM_000681
aagccattattctctgatgcactgtttgccccagtaactcactttaaaacctctctttccagtgttccctctctccctccagggccactgcttgaagaagaatatgtatgtttctatcttgtatgtctgtgtgcccctcctgccccgaaagtgctgactatggggaaatcttttagctgctgtttttagactccaaggagtggaaattatgtggaagaagcaaacctgatacaatttgcccaaggtaaacagtttgaaaagacaaatgggcctgccaaactgtacagtttcttccccaagagctgttaggtatcaaaatgttgtcctttcccccctccgtgcttttctggttgagatcatgtcattgatgaactgccaaagtcaggggaggagggcagagactttgtgtttacatctgcatttctacatgttttagacagagacaatttaaggcctgcactcttatttcactaaaga

SEQ ID NO: 1663 - DNA, 25 bp, Artificial sequence
  Affy probe set ID: 209869_at
aagccattattctctgatgcactgt

SEQ ID NO: 1664 - DNA, 25 bp, Artificial sequence
  Affy probe set ID: 209869_at
cagtaactcactttaaaacctctct

SEQ ID NO: 1665 - DNA, 25 bp, Artificial sequence
  Affy probe set ID: 209869_at
ccagggccactgcttgaagaagaat

SEQ ID NO: 1666 - DNA, 25 bp, Artificial sequence
  Affy probe set ID: 209869_at
ctgccccgaaagtgctgactatggg

SEQ ID NO: 1667 - DNA, 25 bp, Artificial sequence
  Affy probe set ID: 209869_at
ttagctgctgtttttagactccaag

SEQ ID NO: 1668 - DNA, 25 bp, Artificial sequence
  Affy probe set ID: 209869_at
caaacctgatacaatttgcccaagg

SEQ ID NO: 1669 - DNA, 25 bp, Artificial sequence
  Affy probe set ID: 209869_at
gccaaactgtacagtttcttcccca

SEQ ID NO: 1670 - DNA, 25 bp, Artificial sequence
  Affy probe set ID: 209869_at
cctccgtgcttttctggttgagatc

SEQ ID NO: 1671 - DNA, 25 bp, Artificial sequence
  Affy probe set ID: 209869_at
tttgtgtttacatctgcatttctac

SEQ ID NO: 1672 - DNA, 25 bp, Artificial sequence
  Affy probe set ID: 209869_at
gagacaatttaaggcctgcactctt

SEQ ID NO: 1673 - DNA, 25 bp, Artificial sequence
  Affy probe set ID: 209869_at
gcctgcactcttatttcactaaaga

SEQ ID NO: 1674 - DNA, 479 bp, Artificial sequence
  Target_Sequence, Fragment of GenBank Accession No. NM_006622
gtggtacgaaaacaattcccctgtggcctgctggactgggtggaacccagaaccaggctaaggcatacagttcttgactttggacaatcccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaat

SEQ ID NO: 1675 - DNA, 25 bp, Artificial sequence
  Affy probe set ID: 201939_at
gtggtacgaaaacaattcccctgtg

SEQ ID NO: 1676 - DNA, 25 bp, Artificial sequence
  Affy probe set ID: 201939_at
ggaacccagaaccaggctaaggcat

SEQ ID NO: 1677 - DNA, 25 bp, Artificial sequence
  Affy probe set ID: 201939_at
ggctaaggcatacagttcttgactt

SEQ ID NO: 1678 - DNA, 25 bp, Artificial sequence
  Affy probe set ID: 201939_at
cagttcttgactttggacaatccca

SEQ ID NO: 1679 - DNA, 25 bp, Artificial sequence
  Affy probe set ID: 201939_at
gagtgaaccagaatgcagttttcct

SEQ ID NO: 1680 - DNA, 25 bp, Artificial sequence
  Affy probe set ID: 201939_at
gcagttttccttgagatacctgttt

SEQ ID NO: 1681 - DNA, 25 bp, Artificial sequence
  Affy probe set ID: 201939_at
tctctgttgagagcatttcagccag

SEQ ID NO: 1682 - DNA, 25 bp, Artificial sequence
  Affy probe set ID: 201939_at
tcagccagaggactttggaactgtg

SEQ ID NO: 1683 - DNA, 25 bp, Artificial sequence
  Affy probe set ID: 201939_at
gggaggaagctcccatgttgtttaa

SEQ ID NO: 1684 - DNA, 25 bp, Artificial sequence
  Affy probe set ID: 201939_at
agcttttggctgcgtaactgtgaac

SEQ ID NO: 1685 - DNA, 25 bp, Artificial sequence
  Affy probe set ID: 201939_at
ttgaccattttaaaccgttggcaat

SEQ ID NO: 1686 - DNA, 419 bp, Artificial sequence
  Target_Sequence, Fragment of GenBank Accession No. AL528626
gactcctaacttatgtgtctactctgcctagaaagaaagttttgaaggcatctatatatatttcataacaatgtctgttctttatggatttgatccataaatatttatctatctgaaaactttgatacttggaatgttttccttagagcatttggtgctccaagaaaaaacatttggtgctaagagttgcagcactgatgcctttccctaagttaattctattttaaaaatttatatttccttcccaatgagatgcagagtaaaatttgagaccctccattgactagggagcagcatctgtcatctatggttaattactattttgacaaaaatatagaaggtttaaacccccatgtatttcagattgttagagaaagaagtagtttgcttatatttcccttgaactttattctaaccat

SEQ ID NO: 1687 - DNA, 25 bp, Artificial sequence
  Affy probe set ID: 228573_at
gactcctaacttatgtgtctactct

SEQ ID NO: 1688 - DNA, 25 bp, Artificial sequence
  Affy probe set ID: 228573_at
atgtctgttctttatggatttgatc

SEQ ID NO: 1689 - DNA, 25 bp, Artificial sequence
  Affy probe set ID: 228573_at
atgttttccttagagcatttggtgc

SEQ ID NO: 1690 - DNA, 25 bp, Artificial sequence
  Affy probe set ID: 228573_at
actgatgcctttccctaagttaatt

SEQ ID NO: 1691 - DNA, 25 bp, Artificial sequence
  Affy probe set ID: 228573_at
ccttcccaatgagatgcagagtaaa

SEQ ID NO: 1692 - DNA, 25 bp, Artificial sequence
  Affy probe set ID: 228573_at
aaaatttgagaccctccattgacta

SEQ ID NO: 1693 - DNA, 25 bp, Artificial sequence
  Affy probe set ID: 228573_at
ccattgactagggagcagcatctgt

SEQ ID NO: 1694 - DNA, 25 bp, Artificial sequence
  Affy probe set ID: 228573_at
gagcagcatctgtcatctatggtta

SEQ ID NO: 1695 - DNA, 25 bp, Artificial sequence
  Affy probe set ID: 228573_at
aacccccatgtatttcagattgtta

SEQ ID NO: 1696 - DNA, 25 bp, Artificial sequence
  Affy probe set ID: 228573_at
gaagtagtttgcttatatttccctt

SEQ ID NO: 1697 - DNA, 25 bp, Artificial sequence
  Affy probe set ID: 228573_at
ttcccttgaactttattctaaccat

SEQ ID NO: 1698 - DNA, 545 bp, Artificial sequence
  Target_Sequence, Fragment of GenBank Accession No. AF180519
aaatagcattaaactggaattgacagagtgagttgagcatctctgtctaacctgctctttctctctggtgctcctcatctcacccctaccttggaatttaataagcttcaggcatttccaattgcagactaaaaccacttctaccatctcctctagtattttccatgtatcaggacagagatgtcttatgtagggaaggggcaggtatgaagtgaggtagattatctatacctctcactcattcaggattctcgctcccatgctgctgtcccttcattctcacactcacaggaatgctatgtgatggccagctgcttcccttcttggttatccactgcagctgctagttagaaaggtttgcagggatgacttttagtaaatcatggggattttattgatttattatcacttataggattttgtggggtgggagtggggagcaggaattgcactcagacatgacatttcaattcatctctgcaaatgaaaagggttcttcctcttgggggaaatctgtgtgtcagttctgtcagctgcaagttctt

SEQ ID NO: 1699 - DNA, 25 bp, Artificial sequence
  Affy probe set ID: 211458_s_at
aaatagcattaaactggaattgaca

SEQ ID NO: 1700 - DNA, 25 bp, Artificial sequence
  Affy probe set ID: 211458_s_at
atccactgcagctgctagttagaaa

SEQ ID NO: 1701 - DNA, 25 bp, Artificial sequence
  Affy probe set ID: 211458_s_at
actgcagctgctagttagaaaggtt

SEQ ID NO: 1702 - DNA, 25 bp, Artificial sequence
  Affy probe set ID: 211458_s_at
gtggggagcaggaattgcactcaga

SEQ ID NO: 1703 - DNA, 25 bp, Artificial sequence
  Affy probe set ID: 211458_s_at
agcaggaattgcactcagacatgac

SEQ ID NO: 1704 - DNA, 25 bp, Artificial sequence
  Affy probe set ID: 211458_s_at
gaattgcactcagacatgacatttc

SEQ ID NO: 1705 - DNA, 25 bp, Artificial sequence
  Affy probe set ID: 211458_s_at
gcactcagacatgacatttcaattc

SEQ ID NO: 1706 - DNA, 25 bp, Artificial sequence
  Affy probe set ID: 211458_s_at
acatgacatttcaattcatctctgc

SEQ ID NO: 1707 - DNA, 25 bp, Artificial sequence
  Affy probe set ID: 211458_s_at
tgtgtgtcagttctgtcagctgcaa

SEQ ID NO: 1708 - DNA, 25 bp, Artificial sequence
  Affy probe set ID: 211458_s_at
gtgtcagttctgtcagctgcaagtt

SEQ ID NO: 1709 - DNA, 25 bp, Artificial sequence
  Affy probe set ID: 211458_s_at
tcagttctgtcagctgcaagttctt

SEQ ID NO: 1710 - DNA, 541 bp, Artificial sequence
  Target_Sequence, Fragment of GenBank Accession No. NM_024723
gagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggatttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaa

SEQ ID NO: 1711 - DNA, 25 bp, Artificial sequence
  Affy probe set ID: 219332_at
gagctgatgtacaagtccaaggccc

SEQ ID NO: 1712 - DNA, 25 bp, Artificial sequence
  Affy probe set ID: 219332_at
gccaagcccgaggctctgaagtcac

SEQ ID NO: 1713 - DNA, 25 bp, Artificial sequence
  Affy probe set ID: 219332_at
ggagcagtacgtgagcaccgtgaac

SEQ ID NO: 1714 - DNA, 25 bp, Artificial sequence
  Affy probe set ID: 219332_at
cgaccgcagtgacatcgtggactcg

SEQ ID NO: 1715 - DNA, 25 bp, Artificial sequence
  Affy probe set ID: 219332_at
agttccgcttgtccaagatctggtc

SEQ ID NO: 1716 - DNA, 25 bp, Artificial sequence
  Affy probe set ID: 219332_at
tagccagtagggccgtgggctcggc

SEQ ID NO: 1717 - DNA, 25 bp, Artificial sequence
  Affy probe set ID: 219332_at
ggcatccggatttggactcggggcc

SEQ ID NO: 1718 - DNA, 25 bp, Artificial sequence
  Affy probe set ID: 219332_at
ccggcattcggacttggactcggga

SEQ ID NO: 1719 - DNA, 25 bp, Artificial sequence
  Affy probe set ID: 219332_at
cctcctgtccctacaaggggcatgt

SEQ ID NO: 1720 - DNA, 25 bp, Artificial sequence
  Affy probe set ID: 219332_at
tggacagcagggacctgcgctaccg

SEQ ID NO: 1721 - DNA, 25 bp, Artificial sequence
  Affy probe set ID: 219332_at
cgctaccgtctgtggtctcaataaa

SEQ ID NO: 1722 - DNA, 394 bp, Artificial sequence
  Target_Sequence, Fragment of GenBank Accession No. NM_057177
aagcctagaatctcacacacagctgtgacttctaagtgaaactcttttctccctcatgtccttaaatagtcacagaatcacacacagcctgacttttaaagacaagcttggctacaggaaatgaaccaaccccaaagactcttctaacctgtctcctgactgggctccttcagaaagtgttctcctgttccatctgtagggctgcttactactggaacctaaaacaaaacctgttgtttgtaccatcactttttctggtgtttcctgtgcttttgtgattccaagtctgttcataagttctgaagataaattatgtgaaatcatattttggcatatgggggtggaggatgaattctttacagactttttaagatgatccatttgtaccacagaa

SEQ ID NO: 1723 - DNA, 25 bp, Artificial sequence
  Affy probe set ID: 228411_at
aagcctagaatctcacacacagctg

SEQ ID NO: 1724 - DNA, 25 bp, Artificial sequence
  Affy probe set ID: 228411_at
acacacagctgtgacttctaagtga

SEQ ID NO: 1725 - DNA, 25 bp, Artificial sequence
  Affy probe set ID: 228411_at
ttctccctcatgtccttaaatagtc

SEQ ID NO: 1726 - DNA, 25 bp, Artificial sequence
  Affy probe set ID: 228411_at
atagtcacagaatcacacacagcct

SEQ ID NO: 1727 - DNA, 25 bp, Artificial sequence
  Affy probe set ID: 228411_at
gaatcacacacagcctgacttttaa

SEQ ID NO: 1728 - DNA, 25 bp, Artificial sequence
  Affy probe set ID: 228411_at
agggctgcttactactggaacctaa

SEQ ID NO: 1729 - DNA, 25 bp, Artificial sequence
  Affy probe set ID: 228411_at
acctgttgtttgtaccatcactttt

SEQ ID NO: 1730 - DNA, 25 bp, Artificial sequence
  Affy probe set ID: 228411_at
ccatcactttttctggtgtttcctg

SEQ ID NO: 1731 - DNA, 25 bp, Artificial sequence
  Affy probe set ID: 228411_at
gtttcctgtgcttttgtgattccaa

SEQ ID NO: 1732 - DNA, 25 bp, Artificial sequence
  Affy probe set ID: 228411_at
gtgattccaagtctgttcataagtt

SEQ ID NO: 1733 - DNA, 25 bp, Artificial sequence
  Affy probe set ID: 228411_at
aagatgatccatttgtaccacagaa

SEQ ID NO: 1734 - DNA, 567 bp, Artificial sequence
  Target_Sequence, Fragment of GenBank Accession No. NM_004949
aatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcctagggccattgtaagtcacttgaataaaaaatagttttgaagcatgagagtcatacagagcggtccacctaaaaggcactc

SEQ ID NO: 1735 - DNA, 25 bp, Artificial sequence
  Affy probe set ID: 226817_at
aatgtgcctgtcttcaattcacaag

SEQ ID NO: 1736 - DNA, 25 bp, Artificial sequence
  Affy probe set ID: 226817_at
atttgccagattaacactagggaat

SEQ ID NO: 1737 - DNA, 25 bp, Artificial sequence
  Affy probe set ID: 226817_at
accagcttatcttatcagtagtttt

SEQ ID NO: 1738 - DNA, 25 bp, Artificial sequence
  Affy probe set ID: 226817_at
gtttaagggatttcgcactccctga

SEQ ID NO: 1739 - DNA, 25 bp, Artificial sequence
  Affy probe set ID: 226817_at
atttcgcactccctgaatcagagaa

SEQ ID NO: 1740 - DNA, 25 bp, Artificial sequence
  Affy probe set ID: 226817_at
cagagaagtaagaccccttccttag

SEQ ID NO: 1741 - DNA, 25 bp, Artificial sequence
  Affy probe set ID: 226817_at
cccttccttagattcctgttataca

SEQ ID NO: 1742 - DNA, 25 bp, Artificial sequence
  Affy probe set ID: 226817_at
agtgcattgttattgccatatttat

SEQ ID NO: 1743 - DNA, 25 bp, Artificial sequence
  Affy probe set ID: 226817_at
atgactattctaaaggctgtgaggc

SEQ ID NO: 1744 - DNA, 25 bp, Artificial sequence
  Affy probe set ID: 226817_at
ggctgtgaggccatggggtattggt

SEQ ID NO: 1745 - DNA, 25 bp, Artificial sequence
  Affy probe set ID: 226817_at
agagcggtccacctaaaaggcactc

SEQ ID NO: 1746 - DNA, 570 bp, Artificial sequence
  Target_Sequence, Fragment of GenBank Accession No. NM_032784
gacagtgttgttttgaccgggagatctagagagtgctcagaattagggcctggcatttggaatcacaggatttatcatcacagaaacaactgttttaagattagttccatcactctcatcctgtatttttataagaaacacaagagtgcataccagaattgaatataccatatgggattggagaaagacaaatgtggaagaaatcatagagctggagactacttttgtgctttacaaaactgtgaaggattgtggtcacctggaacaggtctccaatctatgttagcactatgtggctcagcctctgttaccccttggattatatatcaacctgtaaacatgtgcctgtaacttacttccaaaaacaaaatcatacttattagaagaaaattctgattttatagaaaaaaaatagagcaaggagaatataacatgtttgcaaagtcatgtgttttctttctcaatgagggaaaaacaattttattacctgcttaatggtccacctggaactaaaagggatactattttctaacaaggtatatctagtaggggagaaagccaccacaataa

SEQ ID NO: 1747 - DNA, 25 bp, Artificial sequence
  Affy probe set ID: 228186_s_at
gacagtgttgttttgaccgggagat

SEQ ID NO: 1748 - DNA, 25 bp, Artificial sequence
  Affy probe set ID: 228186_s_at
gagtgctcagaattagggcctggca

SEQ ID NO: 1749 - DNA, 25 bp, Artificial sequence
  Affy probe set ID: 228186_s_at
taagattagttccatcactctcatc

SEQ ID NO: 1750 - DNA, 25 bp, Artificial sequence
  Affy probe set ID: 228186_s_at
gctggagactacttttgtgctttac

SEQ ID NO: 1751 - DNA, 25 bp, Artificial sequence
  Affy probe set ID: 228186_s_at
acaggtctccaatctatgttagcac

SEQ ID NO: 1752 - DNA, 25 bp, Artificial sequence
  Affy probe set ID: 228186_s_at
agcactatgtggctcagcctctgtt

SEQ ID NO: 1753 - DNA, 25 bp, Artificial sequence
  Affy probe set ID: 228186_s_at
cctctgttaccccttggattatata

SEQ ID NO: 1754 - DNA, 25 bp, Artificial sequence
  Affy probe set ID: 228186_s_at
tatcaacctgtaaacatgtgcctgt

SEQ ID NO: 1755 - DNA, 25 bp, Artificial sequence
  Affy probe set ID: 228186_s_at
catgtgcctgtaacttacttccaaa

SEQ ID NO: 1756 - DNA, 25 bp, Artificial sequence
  Affy probe set ID: 228186_s_at
ttattacctgcttaatggtccacct

SEQ ID NO: 1757 - DNA, 25 bp, Artificial sequence
  Affy probe set ID: 228186_s_at
gtaggggagaaagccaccacaataa

SEQ ID NO: 1758 - DNA, 489 bp, Artificial sequence
  Target_Sequence, Fragment of GenBank Accession No. NM_007039
aattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaat

SEQ ID NO: 1759 - DNA, 25 bp, Artificial sequence
  Affy probe set ID: 226380_at
aattgaaagtacgcacacttctcat

SEQ ID NO: 1760 - DNA, 25 bp, Artificial sequence
  Affy probe set ID: 226380_at
gtacgcacacttctcatgtaggaac

SEQ ID NO: 1761 - DNA, 25 bp, Artificial sequence
  Affy probe set ID: 226380_at
aaatattcagaacgagctccttaga

SEQ ID NO: 1762 - DNA, 25 bp, Artificial sequence
  Affy probe set ID: 226380_at
tactggaactattttccatctctag

SEQ ID NO: 1763 - DNA, 25 bp, Artificial sequence
  Affy probe set ID: 226380_at
ctctagaaaaagtgcttcttcccct

SEQ ID NO: 1764 - DNA, 25 bp, Artificial sequence
  Affy probe set ID: 226380_at
tccctctccatggtacgtttttgtg

SEQ ID NO: 1765 - DNA, 25 bp, Artificial sequence
  Affy probe set ID: 226380_at
ctctccatggtacgtttttgtgaaa

SEQ ID NO: 1766 - DNA, 25 bp, Artificial sequence
  Affy probe set ID: 226380_at
atatgtggtctatttgtgttcctgt

SEQ ID NO: 1767 - DNA, 25 bp, Artificial sequence
  Affy probe set ID: 226380_at
gtgttcctgttgtaataatttgata

SEQ ID NO: 1768 - DNA, 25 bp, Artificial sequence
  Affy probe set ID: 226380_at
catgtttggcgtcattcctaagagc

SEQ ID NO: 1769 - DNA, 25 bp, Artificial sequence
  Affy probe set ID: 226380_at
gcgtcattcctaagagccatgtaat

SEQ ID NO: 1770 - DNA, 418 bp, Artificial sequence
  Target_Sequence, Fragment of GenBank Accession No. NM_031935
gtgagatcagctgaaccacttatgataataataataaaaaagactgctttgccctcacgtcagttgtacatggcatggaactttaaaaattttaatataaactttcatccagttagcttcataacttttacgttccagaattttgtttattttcctgtcaatgaaagcaatttttaaagataccagtgggacaggtttggttttttaaaaatctcatgtgttcaaattaacataaatattacacgtcaatacactgtacatggtggtaatagactctaagcaattgccaagatgtattctatttttatgaagtgtatatatattaccttagtgtgcattttctatataatatcttgatggactcttttataaaattattttataaaaaacaatgttacactaaaatcagcctaaataa

SEQ ID NO: 1771 - DNA, 25 bp, Artificial sequence
  Affy probe set ID: 235944_at
gtgagatcagctgaaccacttatga

SEQ ID NO: 1772 - DNA, 25 bp, Artificial sequence
  Affy probe set ID: 235944_at
ccctcacgtcagttgtacatggcat

SEQ ID NO: 1773 - DNA, 25 bp, Artificial sequence
  Affy probe set ID: 235944_at
aaactttcatccagttagcttcata

SEQ ID NO: 1774 - DNA, 25 bp, Artificial sequence
  Affy probe set ID: 235944_at
agcttcataacttttacgttccaga

SEQ ID NO: 1775 - DNA, 25 bp, Artificial sequence
  Affy probe set ID: 235944_at
taaagataccagtgggacaggtttg

SEQ ID NO: 1776 - DNA, 25 bp, Artificial sequence
  Affy probe set ID: 235944_at
attacacgtcaatacactgtacatg

SEQ ID NO: 1777 - DNA, 25 bp, Artificial sequence
  Affy probe set ID: 235944_at
taatagactctaagcaattgccaag

SEQ ID NO: 1778 - DNA, 25 bp, Artificial sequence
  Affy probe set ID: 235944_at
gcaattgccaagatgtattctattt

SEQ ID NO: 1779 - DNA, 25 bp, Artificial sequence
  Affy probe set ID: 235944_at
tatattaccttagtgtgcattttct

SEQ ID NO: 1780 - DNA, 25 bp, Artificial sequence
  Affy probe set ID: 235944_at
tatcttgatggactcttttataaaa

SEQ ID NO: 1781 - DNA, 25 bp, Artificial sequence
  Affy probe set ID: 235944_at
gttacactaaaatcagcctaaataa

SEQ ID NO: 1782 - DNA, 434 bp, Artificial sequence
  Target_Sequence, Fragment of GenBank Accession No. AK022877
tgagagctgtctaggtctgtatcccagattgttgcttaatgacatctgacagatgcattgttttctgaaatcagcttaagacaccaattgtggcaactggaaactcattacctgctgcattggatcaactatggaagttggagcaggggtgggcggaggtcacctaaccaatcaatggaaggcaactcacacctgctccaagcctcagctttgagaaacaaacacgtttataagaaaaaatatatagctattattacagaagtgaatatgttgtgctctcttactgctcttggtgcattgacagtttctgtatctcaaccctattcatctttatgaaaaagcattctgaagatctatcctcagcactgctgagtgtgcagtcacactttcctaccaacccccttcttaccatctctagctgccatttgtggggg

SEQ ID NO: 1783 - DNA, 25 bp, Artificial sequence
  Affy probe set ID: 213169_at
tgagagctgtctaggtctgtatccc

SEQ ID NO: 1784 - DNA, 25 bp, Artificial sequence
  Affy probe set ID: 213169_at
actggaaactcattacctgctgcat

SEQ ID NO: 1785 - DNA, 25 bp, Artificial sequence
  Affy probe set ID: 213169_at
ggagcaggggtgggcggaggtcacc

SEQ ID NO: 1786 - DNA, 25 bp, Artificial sequence
  Affy probe set ID: 213169_at
caatggaaggcaactcacacctgct

SEQ ID NO: 1787 - DNA, 25 bp, Artificial sequence
  Affy probe set ID: 213169_at
ctgctccaagcctcagctttgagaa

SEQ ID NO: 1788 - DNA, 25 bp, Artificial sequence
  Affy probe set ID: 213169_at
gaatatgttgtgctctcttactgct

SEQ ID NO: 1789 - DNA, 25 bp, Artificial sequence
  Affy probe set ID: 213169_at
ctcttactgctcttggtgcattgac

SEQ ID NO: 1790 - DNA, 25 bp, Artificial sequence
  Affy probe set ID: 213169_at
tgacagtttctgtatctcaacccta

SEQ ID NO: 1791 - DNA, 25 bp, Artificial sequence
  Affy probe set ID: 213169_at
tatctcaaccctattcatctttatg

SEQ ID NO: 1792 - DNA, 25 bp, Artificial sequence
  Affy probe set ID: 213169_at
ctgaagatctatcctcagcactgct

SEQ ID NO: 1793 - DNA, 25 bp, Artificial sequence
  Affy probe set ID: 213169_at
catctctagctgccatttgtggggg

SEQ ID NO: 1794 - DNA, 297 bp, Artificial sequence
  Target_Sequence, Fragment of GenBank Accession No. AK127644
ggttaatatacatactgagctcctaaagtttaaattcaggtactgagtgtacaatttcaccaacattctaacccatgaaacttttacactctgtgccaagaaactgttggcttttgtaaggtacagtgctcaacatttgcagattcaggtctcaagaagcagagatgtctcataagcagcattttcccaacagtttagcatctgtacacatctgccttggtcatcagtccactcacagagtaccatactttatcatcacaagtgtctgacgtgaacgaatgccattttctattccat

SEQ ID NO: 1795 - DNA, 25 bp, Artificial sequence
  Affy probe set ID: 236297_at
ggttaatatacatactgagctccta

SEQ ID NO: 1796 - DNA, 25 bp, Artificial sequence
  Affy probe set ID: 236297_at
caatttcaccaacattctaacccat

SEQ ID NO: 1797 - DNA, 25 bp, Artificial sequence
  Affy probe set ID: 236297_at
aacccatgaaacttttacactctgt

SEQ ID NO: 1798 - DNA, 25 bp, Artificial sequence
  Affy probe set ID: 236297_at
tacactctgtgccaagaaactgttg

SEQ ID NO: 1799 - DNA, 25 bp, Artificial sequence
  Affy probe set ID: 236297_at
aacatttgcagattcaggtctcaag

SEQ ID NO: 1800 - DNA, 25 bp, Artificial sequence
  Affy probe set ID: 236297_at
gtctcataagcagcattttcccaac

SEQ ID NO: 1801 - DNA, 25 bp, Artificial sequence
  Affy probe set ID: 236297_at
acagtttagcatctgtacacatctg

SEQ ID NO: 1802 - DNA, 25 bp, Artificial sequence
  Affy probe set ID: 236297_at
tacacatctgccttggtcatcagtc

SEQ ID NO: 1803 - DNA, 25 bp, Artificial sequence
  Affy probe set ID: 236297_at
gtcatcagtccactcacagagtacc

SEQ ID NO: 1804 - DNA, 25 bp, Artificial sequence
  Affy probe set ID: 236297_at
agagtaccatactttatcatcacaa

SEQ ID NO: 1805 - DNA, 25 bp, Artificial sequence
  Affy probe set ID: 236297_at
gaacgaatgccattttctattccat

SEQ ID NO: 1806 - DNA, 487 bp, Artificial sequence
  Target_Sequence, Fragment of GenBank Accession No. AK056963
gggctgacccagacatttaatcaccatctcttatgttgttgccgtaagaaatgcattccaggttgggacttgggatcctgagagcacattcgccccctgtggtggccgcttgccaccttgcaagatggaagcccagtctccttactaccaaactgtagttgtaagcagagggaggggtgagatgtttataggacattccctaagctggggagtgatttttatcactattcatgtcaactgtactttggtatagactccctatcaatttaataatatgaaaagcctaaaataaaactatgcatgctattctatgtgctattttatatcagtaaataagcttatgcttgccagttgtatacacagttatgaggtgtatagaactgactttgacagtattttttgcactgtttcctatctgtttttataaagtcttatttagatattggaccttgttgatgttctcactgcccttgtgcttgctataaaa

SEQ ID NO: 1807 - DNA, 25 bp, Artificial sequence
  Affy probe set ID: 226282_at
gggctgacccagacatttaatcacc

SEQ ID NO: 1808 - DNA, 25 bp, Artificial sequence
  Affy probe set ID: 226282_at
tcaccatctcttatgttgttgccgt

SEQ ID NO: 1809 - DNA, 25 bp, Artificial sequence
  Affy probe set ID: 226282_at
ttgggatcctgagagcacattcgcc

SEQ ID NO: 1810 - DNA, 25 bp, Artificial sequence
  Affy probe set ID: 226282_at
tgcaagatggaagcccagtctcctt

SEQ ID NO: 1811 - DNA, 25 bp, Artificial sequence
  Affy probe set ID: 226282_at
cccagtctccttactaccaaactgt

SEQ ID NO: 1812 - DNA, 25 bp, Artificial sequence
  Affy probe set ID: 226282_at
atcactattcatgtcaactgtactt

SEQ ID NO: 1813 - DNA, 25 bp, Artificial sequence
  Affy probe set ID: 226282_at
gtactttggtatagactccctatca

SEQ ID NO: 1814 - DNA, 25 bp, Artificial sequence
  Affy probe set ID: 226282_at
gcttatgcttgccagttgtatacac

SEQ ID NO: 1815 - DNA, 25 bp, Artificial sequence
  Affy probe set ID: 226282_at
tgcactgtttcctatctgtttttat

SEQ ID NO: 1816 - DNA, 25 bp, Artificial sequence
  Affy probe set ID: 226282_at
tggaccttgttgatgttctcactgc

SEQ ID NO: 1817 - DNA, 25 bp, Artificial sequence
  Affy probe set ID: 226282_at
cactgcccttgtgcttgctataaaa

SEQ ID NO: 1818 - DNA, 442 bp, Artificial sequence
  Target_Sequence, Fragment of GenBank Accession No. NM_000899
  misc_feature (75)..(75): n is a, c, g, or t
  misc_feature (88)..(88): n is a, c, g, or t
  misc_feature (119)..(120): n is a, c, g, or t
ttataactgccatctccaactacatccttatgatgtttttaacaataaaattaaaacaactgttaaactaaaaanccacaccgttttnccagtacttgatctctgagctacaatactcnnctaaatataattttccaatcaaaatattctattctatattctaagggttaatatgtgattatagtgtccacttgccaccatttttttaaatcaatggacttgaaaagtattaatttagatggatgcgcagatataccctcagttcagtcatagattggagtttgcatataataatgtaaatgtatgtcgacactattctaaatagttctattatgactgaaatttaattaaataaaaaaggttgtaaaatgtgatgtgtatgtgtatatactgtatgtgtactttttaaaataggtgtatgtcccaacccttttttatacag

SEQ ID NO: 1819 - DNA, 25 bp, Artificial sequence
  Affy probe set ID: 226534_at
ttataactgccatctccaactacat

SEQ ID NO: 1820 - DNA, 25 bp, Artificial sequence
  Affy probe set ID: 226534_at
ccatctccaactacatccttatgat

SEQ ID NO: 1821 - DNA, 25 bp, Artificial sequence
  Affy probe set ID: 226534_at
ccagtacttgatctctgagctacaa

SEQ ID NO: 1822 - DNA, 25 bp, Artificial sequence
  Affy probe set ID: 226534_at
acttgatctctgagctacaatactc

SEQ ID NO: 1823 - DNA, 25 bp, Artificial sequence
  Affy probe set ID: 226534_at
gattatagtgtccacttgccaccat

SEQ ID NO: 1824 - DNA, 25 bp, Artificial sequence
  Affy probe set ID: 226534_at
atggatgcgcagatataccctcagt

SEQ ID NO: 1825 - DNA, 25 bp, Artificial sequence
  Affy probe set ID: 226534_at
gcagatataccctcagttcagtcat

SEQ ID NO: 1826 - DNA, 25 bp, Artificial sequence
  Affy probe set ID: 226534_at
taccctcagttcagtcatagattgg

SEQ ID NO: 1827 - DNA, 25 bp, Artificial sequence
  Affy probe set ID: 226534_at
gtaaatgtatgtcgacactattcta

SEQ ID NO: 1828 - DNA, 25 bp, Artificial sequence
  Affy probe set ID: 226534_at
taaaataggtgtatgtcccaaccct

SEQ ID NO: 1829 - DNA, 25 bp, Artificial sequence
  Affy probe set ID: 226534_at
tatgtcccaacccttttttatacag

SEQ ID NO: 1830 - DNA, 422 bp, Artificial sequence
  Target_Sequence, Fragment of GenBank Accession No. NM_002387
  misc_feature (30)..(30): n is a, c, g, or t
  misc_feature (72)..(72): n is a, c, g, or t
  misc_feature (188)..(188): n is a, c, g, or t
  misc_feature (397)..(397): n is a, c, g, or t
tcacttatagtgctcatgtcaggaatggcnagtgagtaagagcccctgataatctgcttttgttagaacgtnatgcaaagataataaaacatgtccacttcttttctagttctaatcagtttttagacatcaagatttatttactttgcatgagatttgtttcctattatttgaatatgtgctatacncttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaanatagctactttgcgttatttgatat

SEQ ID NO: 1831 - DNA, 25 bp, Artificial sequence
  Affy probe set ID: 226225_at
tcacttatagtgctcatgtcaggaa

SEQ ID NO: 1832 - DNA, 25 bp, Artificial sequence
  Affy probe set ID: 226225_at
agagcccctgataatctgcttttgt

SEQ ID NO: 1833 - DNA, 25 bp, Artificial sequence
  Affy probe set ID: 226225_at
aaacatgtccacttcttttctagtt

SEQ ID NO: 1834 - DNA, 25 bp, Artificial sequence
  Affy probe set ID: 226225_at
gaaaaacctgcttgaatgtattgtc

SEQ ID NO: 1835 - DNA, 25 bp, Artificial sequence
  Affy probe set ID: 226225_at
agcacatgtgactaagtttgcattt

SEQ ID NO: 1836 - DNA, 25 bp, Artificial sequence
  Affy probe set ID: 226225_at
tttgcatttgtcagtattgttctac

SEQ ID NO: 1837 - DNA, 25 bp, Artificial sequence
  Affy probe set ID: 226225_at
gctacttaacactgtactatacctt

SEQ ID NO: 1838 - DNA, 25 bp, Artificial sequence
  Affy probe set ID: 226225_at
ttttagattctccacttgtattctt

SEQ ID NO: 1839 - DNA, 25 bp, Artificial sequence
  Affy probe set ID: 226225_at
tctttaaatgtttccagatgccttt

SEQ ID NO: 1840 - DNA, 25 bp, Artificial sequence
  Affy probe set ID: 226225_at
gatgcctttagttttagctgctgta

SEQ ID NO: 1841 - DNA, 25 bp, Artificial sequence
  Affy probe set ID: 226225_at
atagctactttgcgttatttgatat

SEQ ID NO: 1842 - DNA, 363 bp, Artificial sequence
  Target_Sequence, Fragment of GenBank Accession No. NM_198270
tttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaa

SEQ ID NO: 1843 - DNA, 25 bp, Artificial sequence
  Affy probe set ID: 228933_at
tttgctcttgccaaaggtcagtgag

SEQ ID NO: 1844 - DNA, 25 bp, Artificial sequence
  Affy probe set ID: 228933_at
gagtgagtgcatttgctgcagtggt

SEQ ID NO: 1845 - DNA, 25 bp, Artificial sequence
  Affy probe set ID: 228933_at
gctgcagtggtggcacgtagagaac

SEQ ID NO: 1846 - DNA, 25 bp, Artificial sequence
  Affy probe set ID: 228933_at
cagttcatgctggccgaaacgacaa

SEQ ID NO: 1847 - DNA, 25 bp, Artificial sequence
  Affy probe set ID: 228933_at
acgacaatggtttatggacttgcat

SEQ ID NO: 1848 - DNA, 25 bp, Artificial sequence
  Affy probe set ID: 228933_at
tggacttgcatccattttgtatttt

SEQ ID NO: 1849 - DNA, 25 bp, Artificial sequence
  Affy probe set ID: 228933_at
gttttcaacgtttacattcaatcca

SEQ ID NO: 1850 - DNA, 25 bp, Artificial sequence
  Affy probe set ID: 228933_at
cattcaatccaagcctttgtatatt

SEQ ID NO: 1851 - DNA, 25 bp, Artificial sequence
  Affy probe set ID: 228933_at
gagctgtgcaacactttaagtcttg

SEQ ID NO: 1852 - DNA, 25 bp, Artificial sequence
  Affy probe set ID: 228933_at
gtgacagtttcattgtgaacccctc

SEQ ID NO: 1853 - DNA, 25 bp, Artificial sequence
  Affy probe set ID: 228933_at
ttcattgtgaacccctctcaaaaaa

SEQ ID NO: 1854 - DNA, 528 bp, Artificial sequence
  Target_Sequence, Fragment of GenBank Accession No. NM_183376
ggattgtcttatcacctttattagataaatcatgaagtgtccctgtgaaattgaagtgaaactatctctgtaggacttaagagaatagctaaaaggtgtgacttgccttattgaactgatactggcatatctgactgtaagcagtaggttgaagatatcattttatgaatgtggagaattctacattgaaacagaaaatacctgggaatgaagattaaaaatgtagctgctgttatttgcttggtgattcccctcttgctcttctttagtttgaaaaaacaaaaacgtggccttggaattttcattttgatgcagaaattttgaaattgaaaatgtgcatgttttggtgcacaaaatccttctgtgggcaaaactttgtttttgttttgcacagtaagaaacaataggcaagcgttatgtttttggtaagttaactatgaaagctttcttatttttattattaaaaatgtaacaatttaacccacaggaaaaaaaattactttgtatgcttgtttgaaccctatgggt

SEQ ID NO: 1855 - DNA, 25 bp, Artificial sequence
  Affy probe set ID: 225283_at
ggattgtcttatcacctttattaga

SEQ ID NO: 1856 - DNA, 25 bp, Artificial sequence
  Affy probe set ID: 225283_at
aatcatgaagtgtccctgtgaaatt

SEQ ID NO: 1857 - DNA, 25 bp, Artificial sequence
  Affy probe set ID: 225283_at
gaagtgaaactatctctgtaggact

SEQ ID NO: 1858 - DNA, 25 bp, Artificial sequence
  Affy probe set ID: 225283_at
gtgtgacttgccttattgaactgat

SEQ ID NO: 1859 - DNA, 25 bp, Artificial sequence
  Affy probe set ID: 225283_at
gatactggcatatctgactgtaagc

SEQ ID NO: 1860 - DNA, 25 bp, Artificial sequence
  Affy probe set ID: 225283_at
atgtagctgctgttatttgcttggt

SEQ ID NO: 1861 - DNA, 25 bp, Artificial sequence
  Affy probe set ID: 225283_at
tgttatttgcttggtgattcccctc

SEQ ID NO: 1862 - DNA, 25 bp, Artificial sequence
  Affy probe set ID: 225283_at
cctcttgctcttctttagtttgaaa

SEQ ID NO: 1863 - DNA, 25 bp, Artificial sequence
  Affy probe set ID: 225283_at
acgtggccttggaattttcattttg

SEQ ID NO: 1864 - DNA, 25 bp, Artificial sequence
  Affy probe set ID: 225283_at
tttggtgcacaaaatccttctgtgg

SEQ ID NO: 1865 - DNA, 25 bp, Artificial sequence
  Affy probe set ID: 225283_at
gtatgcttgtttgaaccctatgggt

SEQ ID NO: 1866 - DNA, 545 bp, Artificial sequence
  Target_Sequence, Fragment of GenBank Accession No. NM_000216
tgccgtgggttttcaagtttactcatttctatggttgcaaataactctaaaacttattatataaactttcatattataggcagaacacaatggctaaatatctgttgcatgtactttaaagtttattataaaatataaacagatatataaagatgttgactcttacctgtgattttgcatggtcagactcggtgtcaggtacggagaggattctcatgactgtcttacctctactgaatattctagtgagttatatgatttacggagtgattaacagaggtctatataaagttacttttcccctttacttaattatattgtagtgtgcagataacaaaactgctaccttctcatccaagtggtctgtagaattcatgtcccttacagtggtcatttaaagtcaatatttatttatgtatgtaataaaaaaagttggatttttgtgtatgtctgtcacattatttagagagaagtaatcttgtaaaaatgttttgtaaaaaacaaaaaagtattgtaaatagtcttgatattctgtgactcattat

SEQ ID NO: 1867 - DNA, 25 bp, Artificial sequence
  Affy probe set ID: 205206_at
tgccgtgggttttcaagtttactca

SEQ ID NO: 1868 - DNA, 25 bp, Artificial sequence
  Affy probe set ID: 205206_at
actcttacctgtgattttgcatggt

SEQ ID NO: 1869 - DNA, 25 bp, Artificial sequence
  Affy probe set ID: 205206_at
tgcatggtcagactcggtgtcaggt

SEQ ID NO: 1870 - DNA, 25 bp, Artificial sequence
  Affy probe set ID: 205206_at
ggtgtcaggtacggagaggattctc

SEQ ID NO: 1871 - DNA, 25 bp, Artificial sequence
  Affy probe set ID: 205206_at
ggattctcatgactgtcttacctct

SEQ ID NO: 1872 - DNA, 25 bp, Artificial sequence
  Affy probe set ID: 205206_at
gactgtcttacctctactgaatatt

SEQ ID NO: 1873 - DNA, 25 bp, Artificial sequence
  Affy probe set ID: 205206_at
ataacaaaactgctaccttctcatc

SEQ ID NO: 1874 - DNA, 25 bp, Artificial sequence
  Affy probe set ID: 205206_at
ctaccttctcatccaagtggtctgt

SEQ ID NO: 1875 - DNA, 25 bp, Artificial sequence
  Affy probe set ID: 205206_at
gtggtctgtagaattcatgtccctt

SEQ ID NO: 1876 - DNA, 25 bp, Artificial sequence
  Affy probe set ID: 205206_at
gtcccttacagtggtcatttaaagt

SEQ ID NO: 1877 - DNA, 25 bp, Artificial sequence
  Affy probe set ID: 205206_at
gtcttgatattctgtgactcattat

SEQ ID NO: 1878 - DNA, 328 bp, Artificial sequence
  Target_Sequence, Fragment of GenBank Accession No. NM_001008224
aacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtc

SEQ ID NO: 1879 - DNA, 25 bp, Artificial sequence
  Affy probe set ID: 223279_s_at
aacaggcactcaatggcctttccca

SEQ ID NO: 1880 - DNA, 25 bp, Artificial sequence
  Affy probe set ID: 223279_s_at
tcacctacacaagtgggaaccccac

SEQ ID NO: 1881 - DNA, 25 bp, Artificial sequence
  Affy probe set ID: 223279_s_at
gaggcagagccagctgattgacact

SEQ ID NO: 1882 - DNA, 25 bp, Artificial sequence
  Affy probe set ID: 223279_s_at
tgattgacactctgcagcaccaagt

SEQ ID NO: 1883 - DNA, 25 bp, Artificial sequence
  Affy probe set ID: 223279_s_at
tggagcaacagctggccgatgctga

SEQ ID NO: 1884 - DNA, 25 bp, Artificial sequence
  Affy probe set ID: 223279_s_at
gcaatttatcggacacaccttctta

SEQ ID NO: 1885 - DNA, 25 bp, Artificial sequence
  Affy probe set ID: 223279_s_at
cacaccttcttagtgctgcacaggg

SEQ ID NO: 1886 - DNA, 25 bp, Artificial sequence
  Affy probe set ID: 223279_s_at
ttcaggaggctctgctccagatcat

SEQ ID NO: 1887 - DNA, 25 bp, Artificial sequence
  Affy probe set ID: 223279_s_at
caggggcttgtgtgctagccgttag

SEQ ID NO: 1888 - DNA, 25 bp, Artificial sequence
  Affy probe set ID: 223279_s_at
agcactgactgccagtatctgtttt

SEQ ID NO: 1889 - DNA, 25 bp, Artificial sequence
  Affy probe set ID: 223279_s_at
acattctttgtgcaactccatggtc

SEQ ID NO: 1890 - DNA, 315 bp, Artificial sequence
  Target_Sequence, Fragment of GenBank Accession No. NM_133493
catgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggtttggattttcagtaggggacagttgatgtggagtcaatctctttggtacacaggaagctttataaaatttcattcacgaatctcttattttgg

SEQ ID NO: 1891 - DNA, 25 bp, Artificial sequence
  Affy probe set ID: 226545_at
catgtgtctctgtaatagggataat

SEQ ID NO: 1892 - DNA, 25 bp, Artificial sequence
  Affy probe set ID: 226545_at
tctatcttatgttgtcttgaggcca

SEQ ID NO: 1893 - DNA, 25 bp, Artificial sequence
  Affy probe set ID: 226545_at
gaggccaagatttaccacgtttgcc

SEQ ID NO: 1894 - DNA, 25 bp, Artificial sequence
  Affy probe set ID: 226545_at
ttaccacgtttgcccagtgtattga

SEQ ID NO: 1895 - DNA, 25 bp, Artificial sequence
  Affy probe set ID: 226545_at
ggtagaaggtagttccatgttccat

SEQ ID NO: 1896 - DNA, 25 bp, Artificial sequence
  Affy probe set ID: 226545_at
tccatgttccatttgtagatcttta

SEQ ID NO: 1897 - DNA, 25 bp, Artificial sequence
  Affy probe set ID: 226545_at
agaatgtggctcagttctggtcctt

SEQ ID NO: 1898 - DNA, 25 bp, Artificial sequence
  Affy probe set ID: 226545_at
ggtccttcaagcctgtatggtttgg

SEQ ID NO: 1899 - DNA, 25 bp, Artificial sequence
  Affy probe set ID: 226545_at
ttggattttcagtaggggacagttg

SEQ ID NO: 1900 - DNA, 25 bp, Artificial sequence
  Affy probe set ID: 226545_at
ggagtcaatctctttggtacacagg

SEQ ID NO: 1901 - DNA, 25 bp, Artificial sequence
  Affy probe set ID: 226545_at
ttcattcacgaatctcttattttgg

SEQ ID NO: 1902 - DNA, 541 bp, Artificial sequence
  Target_Sequence, Fragment of GenBank Accession No. NM_005545
aatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggcttccttcctcttacccttcctccctcagcctgcaacctctatcctggaacctgtcctccctttctccccaactatgcatctgttgtctgctcct

SEQ ID NO: 1903 - DNA, 25 bp, Artificial sequence
  Affy probe set ID: 207191_s_at
aatctcttctagagcacctgctatc

SEQ ID NO: 1904 - DNA, 25 bp, Artificial sequence
  Affy probe set ID: 207191_s_at
acctgctccaaactagtgactagga

SEQ ID NO: 1905 - DNA, 25 bp, Artificial sequence
  Affy probe set ID: 207191_s_at
gctgctaacagcattgcctgtgctc

SEQ ID NO: 1906 - DNA, 25 bp, Artificial sequence
  Affy probe set ID: 207191_s_at
tcctctcaggggcagcatgctaacg

SEQ ID NO: 1907 - DNA, 25 bp, Artificial sequence
  Affy probe set ID: 207191_s_at
cgacgtcctaatccaactgggagaa

SEQ ID NO: 1908 - DNA, 25 bp, Artificial sequence
  Affy probe set ID: 207191_s_at
gaagcctcagtggtggaattccagg

SEQ ID NO: 1909 - DNA, 25 bp, Artificial sequence
  Affy probe set ID: 207191_s_at
ttccaggcactgtgactgtcaagct

SEQ ID NO: 1910 - DNA, 25 bp, Artificial sequence
  Affy probe set ID: 207191_s_at
attgggggaatggagctggggctta

SEQ ID NO: 1911 - DNA, 25 bp, Artificial sequence
  Affy probe set ID: 207191_s_at
tgctccttgctgttttctgatgatt

SEQ ID NO: 1912 - DNA, 25 bp, Artificial sequence
  Affy probe set ID: 207191_s_at
tttctccccaactatgcatctgttg

SEQ ID NO: 1913 - DNA, 25 bp, Artificial sequence
  Affy probe set ID: 207191_s_at
aactatgcatctgttgtctgctcct

SEQ ID NO: 1914 - DNA, 511 bp, Artificial sequence
  Target_Sequence, Fragment of GenBank Accession No. NM_014365
gggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtttttaagtccggatttttacagaaggaactgtctccagacagctcatcaaggaaccaagcaaaggccagatagcctgacagataggctagtggtaattgtgtatatgggcgggacgtgtgtgtcatta

SEQ ID NO: 1915 - DNA, 25 bp, Artificial sequence
  Affy probe set ID: 221667_s_at
gggacttaacatttcacgttgtatc

SEQ ID NO: 1916 - DNA, 25 bp, Artificial sequence
  Affy probe set ID: 221667_s_at
acgttgtatcttacttgcagtgaat

SEQ ID NO: 1917 - DNA, 25 bp, Artificial sequence
  Affy probe set ID: 221667_s_at
tgcaagggttacttttctctgggga

SEQ ID NO: 1918 - DNA, 25 bp, Artificial sequence
  Affy probe set ID: 221667_s_at
ccatgccgcatggtttggttaatga

SEQ ID NO: 1919 - DNA, 25 bp, Artificial sequence
  Affy probe set ID: 221667_s_at
gcttccacatgcctggcctaaaatg

SEQ ID NO: 1920 - DNA, 25 bp, Artificial sequence
  Affy probe set ID: 221667_s_at
atacaggtcttatatccccatatgg

SEQ ID NO: 1921 - DNA, 25 bp, Artificial sequence
  Affy probe set ID: 221667_s_at
tggaatttatccatcaaccacataa

SEQ ID NO: 1922 - DNA, 25 bp, Artificial sequence
  Affy probe set ID: 221667_s_at
tcaaagtttccacattagcactccc

SEQ ID NO: 1923 - DNA, 25 bp, Artificial sequence
  Affy probe set ID: 221667_s_at
taaggacgctgggagcctgtcagtt

SEQ ID NO: 1924 - DNA, 25 bp, Artificial sequence
  Affy probe set ID: 221667_s_at
gtttatgatctgacctaggtccccc

SEQ ID NO: 1925 - DNA, 25 bp, Artificial sequence
  Affy probe set ID: 221667_s_at
tatgggcgggacgtgtgtgtcatta

SEQ ID NO: 1926 - DNA, 453 bp, Artificial sequence
  Target_Sequence, Fragment of GenBank Accession No. NM_014476
ggatgccgctctgtgacaaatgtggcagtggcatagtcggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaaacccccaagaggctatgacacggtcactctgtatcccaaagcttaagtctctgcaggcgtggcacacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctag

SEQ ID NO: 1927 - DNA, 25 bp, Artificial sequence
  Affy probe set ID: 209621_s_at
ggatgccgctctgtgacaaatgtgg

SEQ ID NO: 1928 - DNA, 25 bp, Artificial sequence
  Affy probe set ID: 209621_s_at
tagtcggtgctgtggtgaaggcgcg

SEQ ID NO: 1929 - DNA, 25 bp, Artificial sequence
  Affy probe set ID: 209621_s_at
gaaggcgcgggataagtaccggcac

SEQ ID NO: 1930 - DNA, 25 bp, Artificial sequence
  Affy probe set ID: 209621_s_at
gcaccctgagtgcttcgtgtgtgcc

SEQ ID NO: 1931 - DNA, 25 bp, Artificial sequence
  Affy probe set ID: 209621_s_at
aggggagctgtactgcgaaacccac

SEQ ID NO: 1932 - DNA, 25 bp, Artificial sequence
  Affy probe set ID: 209621_s_at
gctatgacacggtcactctgtatcc

SEQ ID NO: 1933 - DNA, 25 bp, Artificial sequence
  Affy probe set ID: 209621_s_at
agcttaagtctctgcaggcgtggca

SEQ ID NO: 1934 - DNA, 25 bp, Artificial sequence
  Affy probe set ID: 209621_s_at
ccacgcgcacttacacgagaagaca

SEQ ID NO: 1935 - DNA, 25 bp, Artificial sequence
  Affy probe set ID: 209621_s_at
ggattgtgcagattgtcaactccaa

SEQ ID NO: 1936 - DNA, 25 bp, Artificial sequence
  Affy probe set ID: 209621_s_at
ggctttagacctttatcctattgtt

SEQ ID NO: 1937 - DNA, 25 bp, Artificial sequence
  Affy probe set ID: 209621_s_at
gttttgcaactctttttggggctag

SEQ ID NO: 1938 - DNA, 535 bp, Artificial sequence
  Target_Sequence, Fragment of GenBank Accession No. NM_020962
  misc_feature (114)..(114): n is a, c, g, or t
  misc_feature (117)..(117): n is a, c, g, or t
  misc_feature (210)..(210): n is a, c, g, or t
  misc_feature (473)..(473): n is a, c, g, or t
aggctcttagcattataccacatagtcatttttcatgttcttgtttaacaggcactgaggttctggtttaaattaaatagctgcaaatgagacaatttataacccattaggttnggntggaaaattgtttctcaaaagcaaataagtaataaatctggtatctgcctataactcacagttgataagaaagtggccatttctcactagcantatatatgatttgggctctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgtttttttttnctccttacaaatatgatactctttagtgttaagctaaggcattgattcatgtatctgtcctt

SEQ ID NO: 1939 - DNA, 25 bp, Artificial sequence
  Affy probe set ID: 227870_at
aggctcttagcattataccacatag

SEQ ID NO: 1940 - DNA, 25 bp, Artificial sequence
  Affy probe set ID: 227870_at
taacaggcactgaggttctggttta

SEQ ID NO: 1941 - DNA, 25 bp, Artificial sequence
  Affy probe set ID: 227870_at
atctggtatctgcctataactcaca

SEQ ID NO: 1942 - DNA, 25 bp, Artificial sequence
  Affy probe set ID: 227870_at
agaaagtggccatttctcactagca

SEQ ID NO: 1943 - DNA, 25 bp, Artificial sequence
  Affy probe set ID: 227870_at
gaatctattggccttttacagggta

SEQ ID NO: 1944 - DNA, 25 bp, Artificial sequence
  Affy probe set ID: 227870_at
cagggtattaatccctttgtcacct

SEQ ID NO: 1945 - DNA, 25 bp, Artificial sequence
  Affy probe set ID: 227870_at
ttgtcacctaccattgatgccttaa

SEQ ID NO: 1946 - DNA, 25 bp, Artificial sequence
  Affy probe set ID: 227870_at
gatgccttaagttttctgagtctca

SEQ ID NO: 1947 - DNA, 25 bp, Artificial sequence
  Affy probe set ID: 227870_at
gtgtaatcagtacttgctcatttat

SEQ ID NO: 1948 - DNA, 25 bp, Artificial sequence
  Affy probe set ID: 227870_at
actatttaattatccttccagcgtt

SEQ ID NO: 1949 - DNA, 25 bp, Artificial sequence
  Affy probe set ID: 227870_at
ggcattgattcatgtatctgtcctt

SEQ ID NO: 1950 - DNA, 505 bp, Artificial sequence
  Target_Sequence, Fragment of GenBank Accession No. NM_018357
cgtaggggtgctgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaa

SEQ ID NO: 1951 - DNA, 25 bp, Artificial sequence
  Affy probe set ID: 218651_s_at
cgtaggggtgctgaggttgcccagg

SEQ ID NO: 1952 - DNA, 25 bp, Artificial sequence
  Affy probe set ID: 218651_s_at
aggggtcctgacaacaccagaggat

SEQ ID NO: 1953 - DNA, 25 bp, Artificial sequence
  Affy probe set ID: 218651_s_at
atacaagctccactgaaaaccacct

SEQ ID NO: 1954 - DNA, 25 bp, Artificial sequence
  Affy probe set ID: 218651_s_at
gttctgacaaacacctggcatgaca

SEQ ID NO: 1955 - DNA, 25 bp, Artificial sequence
  Affy probe set ID: 218651_s_at
tggaattcgttcccctttgagagat

SEQ ID NO: 1956 - DNA, 25 bp, Artificial sequence
  Affy probe set ID: 218651_s_at
aaatcggtacgccatggtttgaaga

SEQ ID NO: 1957 - DNA, 25 bp, Artificial sequence
  Affy probe set ID: 218651_s_at
aagaccaccttctagttcaggactc

SEQ ID NO: 1958 - DNA, 25 bp, Artificial sequence
  Affy probe set ID: 218651_s_at
ttcccagcatggccactattttgat

SEQ ID NO: 1959 - DNA, 25 bp, Artificial sequence
  Affy probe set ID: 218651_s_at
gaatttttcccttcagtgactgagc

SEQ ID NO: 1960 - DNA, 25 bp, Artificial sequence
  Affy probe set ID: 218651_s_at
gataggccatgcaagggcttcctga

SEQ ID NO: 1961 - DNA, 25 bp, Artificial sequence
  Affy probe set ID: 218651_s_at
ggaaagttctcttgtgcaacagcaa

SEQ ID NO: 1962 - DNA, 535 bp, Artificial sequence
  Target_Sequence, Fragment of GenBank Accession No. NM_012323
  misc_feature (39)..(39): n is a, c, g, or t
  misc_feature (43)..(44): n is a, c, g, or t
  misc_feature (53)..(53): n is a, c, g, or t
  misc_feature (62)..(62): n is a, c, g, or t
  misc_feature (70)..(70): n is a, c, g, or t
  misc_feature (74)..(74): n is a, c, g, or t
  misc_feature (86)..(86): n is a, c, g, or t
  misc_feature (113)..(113): n is a, c, g, or t
  misc_feature (124)..(124): n is a, c, g, or t
  misc_feature (127)..(127): n is a, c, g, or t
  misc_feature (142)..(142): n is a, c, g, or t
  misc_feature (148)..(148): n is a, c, g, or t
  misc_feature (171)..(465): n is a, c, g, or t
ttgcacggatctaagttattctccccagccagagcccgngctnnctgctcccngggaaaagntggcgtantggncctgagctgggntttatattttatatctgcaaataaatnacattttatcntanatttagggaaagccngagagnaacaacaaaaaatgtttaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgcccggctcctagaatttatttatttcctgacttacagcaagcgagttatcgtcttctgtattttg

SEQ ID NO: 1963 - DNA, 25 bp, Artificial sequence
  Affy probe set ID: 36711_at
ttgcacggatctaagttattctccc

SEQ ID NO: 1964 - DNA, 25 bp, Artificial sequence
  Affy probe set ID: 36711_at
tattgcccggctcctagaatttatt

SEQ ID NO: 1965 - DNA, 25 bp, Artificial sequence
  Affy probe set ID: 36711_at
tttatttcctgacttacagcaagcg

SEQ ID NO: 1966 - DNA, 25 bp, Artificial sequence
  Affy probe set ID: 36711_at
ttatttcctgacttacagcaagcga

SEQ ID NO: 1967 - DNA, 25 bp, Artificial sequence
  Affy probe set ID: 36711_at
tatttcctgacttacagcaagcgag

SEQ ID NO: 1968 - DNA, 25 bp, Artificial sequence
  Affy probe set ID: 36711_at
tttcctgacttacagcaagcgagtt

SEQ ID NO: 1969 - DNA, 25 bp, Artificial sequence
  Affy probe set ID: 36711_at
tcctgacttacagcaagcgagttat

SEQ ID NO: 1970 - DNA, 25 bp, Artificial sequence
  Affy probe set ID: 36711_at
cctgacttacagcaagcgagttatc

SEQ ID NO: 1971 - DNA, 25 bp, Artificial sequence
  Affy probe set ID: 36711_at
ctgacttacagcaagcgagttatcg

SEQ ID NO: 1972 - DNA, 25 bp, Artificial sequence
  Affy probe set ID: 36711_at
tgacttacagcaagcgagttatcgt

SEQ ID NO: 1973 - DNA, 25 bp, Artificial sequence
  Affy probe set ID: 36711_at
ttacagcaagcgagttatcgtcttc

SEQ ID NO: 1974 - DNA, 25 bp, Artificial sequence
  Affy probe set ID: 36711_at
tacagcaagcgagttatcgtcttct

SEQ ID NO: 1975 - DNA, 25 bp, Artificial sequence
  Affy probe set ID: 36711_at
agcaagcgagttatcgtcttctgta

SEQ ID NO: 1976 - DNA, 25 bp, Artificial sequence
  Affy probe set ID: 36711_at
caagcgagttatcgtcttctgtatt

SEQ ID NO: 1977 - DNA, 25 bp, Artificial sequence
  Affy probe set ID: 36711_at
aagcgagttatcgtcttctgtattt

SEQ ID NO: 1978 - DNA, 25 bp, Artificial sequence
  Affy probe set ID: 36711_at
gcgagttatcgtcttctgtattttg

SEQ ID NO: 1979 - DNA, 538 bp, Artificial sequence
  Target_Sequence, Fragment of GenBank Accession No. NM_003713
caaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaacta

SEQ ID NO: 1980 - DNA, 25 bp, Artificial sequence
  Affy probe set ID: 212230_at
caaggtcccactctaggtgatagac

SEQ ID NO: 1981 - DNA, 25 bp, Artificial sequence
  Affy probe set ID: 212230_at
gatagacagggaccccttctactga

SEQ ID NO: 1982 - DNA, 25 bp, Artificial sequence
  Affy probe set ID: 212230_at
ccttctactgaacctttgaggaaag

SEQ ID NO: 1983 - DNA, 25 bp, Artificial sequence
  Affy probe set ID: 212230_at
agatcttggatgcagacctttcaaa

SEQ ID NO: 1984 - DNA, 25 bp, Artificial sequence
  Affy probe set ID: 212230_at
accatatggatcaaccacatgcaca

SEQ ID NO: 1985 - DNA, 25 bp, Artificial sequence
  Affy probe set ID: 212230_at
catgcacatccttactacagaatcc

SEQ ID NO: 1986 - DNA, 25 bp, Artificial sequence
  Affy probe set ID: 212230_at
tactacagaatccgtcctttcattt

SEQ ID NO: 1987 - DNA, 25 bp, Artificial sequence
  Affy probe set ID: 212230_at
acaatttagctatatccactatgat

SEQ ID NO: 1988 - DNA, 25 bp, Artificial sequence
  Affy probe set ID: 212230_at
gattataaactgtgtctcgacctgt

SEQ ID NO: 1989 - DNA, 25 bp, Artificial sequence
  Affy probe set ID: 212230_at
gtgtctcgacctgtgttatttacat

SEQ ID NO: 1990 - DNA, 25 bp, Artificial sequence
  Affy probe set ID: 212230_at
gtgaaaacttgtatctgcgaaacta

SEQ ID NO: 1991 - DNA, 471 bp, Artificial sequence
  Target_Sequence, Fragment of GenBank Accession No. NM_023016
gtcatttaccatggttttcccactgaaggctttaacttttctgataaaataatattttaaattttcaaaaacccattcctgaggagaactacttctagcattccttttcatgatgtgcttttgtgcagtaagtagcattttcggctacttaactttacattcctcttatttttcagtttccagtcaagattataaaaagcaaatgattgatataatttgatattcatagagttgtgcctacctttaatggaaaaatacatgtcagatacttagatgtttattgatatgagactatgtggttaaaaaacccaagtatgtccatgtgtttcttataaggtacacttgaaactagtgagtgtttgtcacatttcactttcatggtatataaaatgcagtttgcatatataacttgaatatctggtactagttttttcacgcctgcaatcttggagtctaggttgccttgtctct

SEQ ID NO: 1992 - DNA, 25 bp, Artificial sequence
  Affy probe set ID: 227034_at
gtcatttaccatggttttcccactg

SEQ ID NO: 1993 - DNA, 25 bp, Artificial sequence
  Affy probe set ID: 227034_at
cccactgaaggctttaacttttctg

SEQ ID NO: 1994 - DNA, 25 bp, Artificial sequence
  Affy probe set ID: 227034_at
gaggagaactacttctagcattcct

SEQ ID NO: 1995 - DNA, 25 bp, Artificial sequence
  Affy probe set ID: 227034_at
gcattttcggctacttaactttaca

SEQ ID NO: 1996 - DNA, 25 bp, Artificial sequence
  Affy probe set ID: 227034_at
gctacttaactttacattcctctta

SEQ ID NO: 1997 - DNA, 25 bp, Artificial sequence
  Affy probe set ID: 227034_at
agagttgtgcctacctttaatggaa

SEQ ID NO: 1998 - DNA, 25 bp, Artificial sequence
  Affy probe set ID: 227034_at
aacccaagtatgtccatgtgtttct

SEQ ID NO: 1999 - DNA, 25 bp, Artificial sequence
  Affy probe set ID: 227034_at
gtgagtgtttgtcacatttcacttt

SEQ ID NO: 2000 - DNA, 25 bp, Artificial sequence
  Affy probe set ID: 227034_at
tctggtactagttttttcacgcctg

SEQ ID NO: 2001 - DNA, 25 bp, Artificial sequence
  Affy probe set ID: 227034_at
ttcacgcctgcaatcttggagtcta

SEQ ID NO: 2002 - DNA, 25 bp, Artificial sequence
  Affy probe set ID: 227034_at
ttggagtctaggttgccttgtctct

SEQ ID NO: 2003 - DNA, 601 bp, Artificial sequence
  Target_Sequence, Fragment of GenBank Accession No. NM_032777
  misc_feature (249)..(251): n is a, c, g, or t
  misc_feature (253)..(259): n is a, c, g, or t
  misc_feature (266)..(268): n is a, c, g, or t
  misc_feature (432)..(457): n is a, c, g, or t
  misc_feature (459)..(461): n is a, c, g, or t
  misc_feature (547)..(565): n is a, c, g, or t
gctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgannnannnnnnnagtctannnactgtccttttgttatgaggtagaggatctcatgacaccatacacacaaacccatcattgcctgtgaatgcacgtagggccagaattccccagttcccgctcctctgagggttgatactgctgggaatgccaaccactccacaagcagagggaagccccctcannnnnnnnnnnnnnnnnnnnnnnnnncnnntctagcagcctgggctctctgaaagtccctaacttcctgaggggtacgcaaatactgttctatttcactatcagaaatgttctcannnnnnnnnnnnnnnnnnncagggggtacagggcagatccgcttcggggacttca

SEQ ID NO: 2004 - DNA, 25 bp, Artificial sequence
  Affy probe set ID: 65718_at
gctgcacagacatattagaagaaaa

SEQ ID NO: 2005 - DNA, 25 bp, Artificial sequence
  Affy probe set ID: 65718_at
tgtattattcttccacatatgctgg

SEQ ID NO: 2006 - DNA, 25 bp, Artificial sequence
  Affy probe set ID: 65718_at
tgctgtttacacaccctgccaatgc

SEQ ID NO: 2007 - DNA, 25 bp, Artificial sequence
  Affy probe set ID: 65718_at
ccaatgccttagcactggagagctt

SEQ ID NO: 2008 - DNA, 25 bp, Artificial sequence
  Affy probe set ID: 65718_at
atgccttagcactggagagcttttt

SEQ ID NO: 2009 - DNA, 25 bp, Artificial sequence
  Affy probe set ID: 65718_at
ccttagcactggagagctttttgca

SEQ ID NO: 2010 - DNA, 25 bp, Artificial sequence
  Affy probe set ID: 65718_at
actggagagctttttgcaatatgct

SEQ ID NO: 2011 - DNA, 25 bp, Artificial sequence
  Affy probe set ID: 65718_at
atagaatgttttctagcagatgcct

SEQ ID NO: 2012 - DNA, 25 bp, Artificial sequence
  Affy probe set ID: 65718_at
ctagcagatgcctcttgttttaata

SEQ ID NO: 2013 - DNA, 25 bp, Artificial sequence
  Affy probe set ID: 65718_at
tagaggatctcatgacaccatacac

SEQ ID NO: 2014 - DNA, 25 bp, Artificial sequence
  Affy probe set ID: 65718_at
caaacccatcattgcctgtgaatgc

SEQ ID NO: 2015 - DNA, 25 bp, Artificial sequence
  Affy probe set ID: 65718_at
tagggccagaattccccagttcccg

SEQ ID NO: 2016 - DNA, 25 bp, Artificial sequence
  Affy probe set ID: 65718_at
gggaatgccaaccactccacaagca

SEQ ID NO: 2017 - DNA, 25 bp, Artificial sequence
  Affy probe set ID: 65718_at
agcagcctgggctctctgaaagtcc

SEQ ID NO: 2018 - DNA, 25 bp, Artificial sequence
  Affy probe set ID: 65718_at
ggtacgcaaatactgttctatttca

SEQ ID NO: 2019 - DNA, 25 bp, Artificial sequence
  Affy probe set ID: 65718_at
gggcagatccgcttcggggacttca

SEQ ID NO: 2020 - DNA, 300 bp, Artificial sequence
  Target_Sequence, Fragment of GenBank Accession No. NM_001554
gccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgc

SEQ ID NO: 2021 - DNA, 25 bp, Artificial sequence
  Affy probe set ID: 201289_at
gccacgattggagaatactttgctt

SEQ ID NO: 2022 - DNA, 25 bp, Artificial sequence
  Affy probe set ID: 201289_at
ggagcacatgttactgcttcatttt

SEQ ID NO: 2023 - DNA, 25 bp, Artificial sequence
  Affy probe set ID: 201289_at
cttcattttggagcttgtggagttg

SEQ ID NO: 2024 - DNA, 25 bp, Artificial sequence
  Affy probe set ID: 201289_at
gtggagttgatgactttctgttttc

SEQ ID NO: 2025 - DNA, 25 bp, Artificial sequence
  Affy probe set ID: 201289_at
gcatattttctctaggcttttttcc

SEQ ID NO: 2026 - DNA, 25 bp, Artificial sequence
  Affy probe set ID: 201289_at
ttggggttctacagtcgtaaaagag

SEQ ID NO: 2027 - DNA, 25 bp, Artificial sequence
  Affy probe set ID: 201289_at
gcttttattcgtcctttgacaaaag

SEQ ID NO: 2028 - DNA, 25 bp, Artificial sequence
  Affy probe set ID: 201289_at
aaatgggagggcattccatcccttc

SEQ ID NO: 2029 - DNA, 25 bp, Artificial sequence
  Affy probe set ID: 201289_at
gcattccatcccttcctgaaggggg

SEQ ID NO: 2030 - DNA, 25 bp, Artificial sequence
  Affy probe set ID: 201289_at
cctgaagggggacactccatgagtg

SEQ ID NO: 2031 - DNA, 25 bp, Artificial sequence
  Affy probe set ID: 201289_at
ggcagctatctgcactctaaactgc

SEQ ID NO: 2032 - DNA, 485 bp, Artificial sequence
  Target_Sequence, Fragment of GenBank Accession No. NM_145117
gacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtctta

SEQ ID NO: 2033 - DNA, 25 bp, Artificial sequence
  Affy probe set ID: 218330_s_at
gacttgcctagatctttgttgtatc

SEQ ID NO: 2034 - DNA, 25 bp, Artificial sequence
  Affy probe set ID: 218330_s_at
tatcttggggacttttactttgttg

SEQ ID NO: 2035 - DNA, 25 bp, Artificial sequence
  Affy probe set ID: 218330_s_at
gatgcttaaacttcaaaattctctg

SEQ ID NO: 2036 - DNA, 25 bp, Artificial sequence
  Affy probe set ID: 218330_s_at
ggaaggtttgctgttttgatctagt

SEQ ID NO: 2037 - DNA, 25 bp, Artificial sequence
  Affy probe set ID: 218330_s_at
ttgatctagttgtttccagtggagc

SEQ ID NO: 2038 - DNA, 25 bp, Artificial sequence
  Affy probe set ID: 218330_s_at
ttgtgtacggtatgtttccatcctc

SEQ ID NO: 2039 - DNA, 25 bp, Artificial sequence
  Affy probe set ID: 218330_s_at
tctcttcctacctatttaattttca

SEQ ID NO: 2040 - DNA, 25 bp, Artificial sequence
  Affy probe set ID: 218330_s_at
tgtcatgaggtttttggatttgcca

SEQ ID NO: 2041 - DNA, 25 bp, Artificial sequence
  Affy probe set ID: 218330_s_at
ggatttgccaatgatctgctggaca

SEQ ID NO: 2042 - DNA, 25 bp, Artificial sequence
  Affy probe set ID: 218330_s_at
tggacatcatgccccatgtcataga

SEQ ID NO: 2043 - DNA, 25 bp, Artificial sequence
  Affy probe set ID: 218330_s_at
aaagctgatgattgtaccagtctta

SEQ ID NO: 2044 - DNA, 277 bp, Artificial sequence
  Target_Sequence, Fragment of GenBank Accession No. NM_001002292
  misc_feature (183)..(183): n is a, c, g, or t
ttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcntcacagtccaagtgaacagtgcctttttcacaggcatctatgggatgtggaatctgtatgtctttgctctgatgttcttgtatgcaccatccca

SEQ ID NO: 2045 - DNA, 25 bp, Artificial sequence
  Affy probe set ID: 228950_s_at
ttcggaacatcagtgggaagcagtc

SEQ ID NO: 2046 - DNA, 25 bp, Artificial sequence
  Affy probe set ID: 228950_s_at
tccagcctgccagctatgagcaaag

SEQ ID NO: 2047 - DNA, 25 bp, Artificial sequence
  Affy probe set ID: 228950_s_at
ccagctatgagcaaagtccggcggc

SEQ ID NO: 2048 - DNA, 25 bp, Artificial sequence
  Affy probe set ID: 228950_s_at
gcaaagtccggcggctacactatga

SEQ ID NO: 2049 - DNA, 25 bp, Artificial sequence
  Affy probe set ID: 228950_s_at
gttcaagttcctcatgcttatcacc

SEQ ID NO: 2050 - DNA, 25 bp, Artificial sequence
  Affy probe set ID: 228950_s_at
catcttcttcatcgttagtcaggta

SEQ ID NO: 2051 - DNA, 25 bp, Artificial sequence
  Affy probe set ID: 228950_s_at
gtcaggtaacggaaggccattggaa

SEQ ID NO: 2052 - DNA, 25 bp, Artificial sequence
  Affy probe set ID: 228950_s_at
acagtgcctttttcacaggcatcta

SEQ ID NO: 2053 - DNA, 25 bp, Artificial sequence
  Affy probe set ID: 228950_s_at
gggatgtggaatctgtatgtctttg

SEQ ID NO: 2054 - DNA, 25 bp, Artificial sequence
  Affy probe set ID: 228950_s_at
tttgctctgatgttcttgtatgcac

SEQ ID NO: 2055 - DNA, 25 bp, Artificial sequence
  Affy probe set ID: 228950_s_at
tgatgttcttgtatgcaccatccca

SEQ ID NO: 2056 - DNA, 515 bp, Artificial sequence
  Target_Sequence, Fragment of GenBank Accession No. NM_001401
  misc_feature (89)..(89): n is a, c, g, or t
  misc_feature (110)..(110): n is a, c, g, or t
  misc_feature (227)..(227): n is a, c, g, or t
  misc_feature (250)..(250): n is a, c, g, or t
  misc_feature (276)..(276): n is a, c, g, or t
aattgccacattttcttatggcattaaaaattttacaaaaacataattttaatggctatattatattccatttaatggatgcaactcangtttatttaaccattcccatngttgttaactatttaggttgtttctaattttcattattataaagttgcagaaatttggtgtacataaaactgtctccatataattgattattaggatatattcccatgaaggattcntttttttaaaaaaatgtgaaatntcatcttgtacttacacctttcatgnaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgta

SEQ ID NO: 2057 - DNA, 25 bp, Artificial sequence
  Affy probe set ID: 204036_at
aattgccacattttcttatggcatt

SEQ ID NO: 2058 - DNA, 25 bp, Artificial sequence
  Affy probe set ID: 204036_at
aagttgcagaaatttggtgtacata

SEQ ID NO: 2059 - DNA, 25 bp, Artificial sequence
  Affy probe set ID: 204036_at
ggtgtacataaaactgtctccatat

SEQ ID NO: 2060 - DNA, 25 bp, Artificial sequence
  Affy probe set ID: 204036_at
tcatcttgtacttacacctttcatg

SEQ ID NO: 2061 - DNA, 25 bp, Artificial sequence
  Affy probe set ID: 204036_at
actagaagaattcaactgtctcaag

SEQ ID NO: 2062 - DNA, 25 bp, Artificial sequence
  Affy probe set ID: 204036_at
ctgtctcaagaatcaaggtacccca

SEQ ID NO: 2063 - DNA, 25 bp, Artificial sequence
  Affy probe set ID: 204036_at
tcaaggtaccccaatatatctcgca

SEQ ID NO: 2064 - DNA, 25 bp, Artificial sequence
  Affy probe set ID: 204036_at
atatctcgcaattccaaactttgtt

SEQ ID NO: 2065 - DNA, 25 bp, Artificial sequence
  Affy probe set ID: 204036_at
gtttgagggactcgttatccagctc

SEQ ID NO: 2066 - DNA, 25 bp, Artificial sequence
  Affy probe set ID: 204036_at
cgttatccagctcttggtagccaca

SEQ ID NO: 2067 - DNA, 25 bp, Artificial sequence
  Affy probe set ID: 204036_at
tcttggtagccacacctgcaatgta

SEQ ID NO: 2068 - DNA, 304 bp, Artificial sequence
  Target_Sequence, Fragment of GenBank Accession No. NM_198282
gtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccactt

SEQ ID NO: 2069 - DNA, 25 bp, Artificial sequence
  Affy probe set ID: 224929_at
gtacttagggggtgtgccaggtgtc

SEQ ID NO: 2070 - DNA, 25 bp, Artificial sequence
  Affy probe set ID: 224929_at
cgccgaactctctcaatggtatcaa

SEQ ID NO: 2071 - DNA, 25 bp, Artificial sequence
  Affy probe set ID: 224929_at
caatggtatcaacaggctccttcgc

SEQ ID NO: 2072 - DNA, 25 bp, Artificial sequence
  Affy probe set ID: 224929_at
gctcctggtcatgttccattattgg

SEQ ID NO: 2073 - DNA, 25 bp, Artificial sequence
  Affy probe set ID: 224929_at
atgttccattattggggagccccag

SEQ ID NO: 2074 - DNA, 25 bp, Artificial sequence
  Affy probe set ID: 224929_at
tgagtttggggtattgaatcccccg

SEQ ID NO: 2075 - DNA, 25 bp, Artificial sequence
  Affy probe set ID: 224929_at
ccaccctgcagcatcaaggttgcta

SEQ ID NO: 2076 - DNA, 25 bp, Artificial sequence
  Affy probe set ID: 224929_at
tcaaggttgctatggactctcctgc

SEQ ID NO: 2077 - DNA, 25 bp, Artificial sequence
  Affy probe set ID: 224929_at
tgccgggcaactcttgcgtaatcat

SEQ ID NO: 2078 - DNA, 25 bp, Artificial sequence
  Affy probe set ID: 224929_at
cttgcgtaatcatgactatctctag

SEQ ID NO: 2079 - DNA, 25 bp, Artificial sequence
  Affy probe set ID: 224929_at
tatctctaggattctggcaccactt

SEQ ID NO: 2080 - DNA, 548 bp, Artificial sequence
  Target_Sequence, Fragment of GenBank Accession No. NM_014934
ggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaata

SEQ ID NO: 2081 - DNA, 25 bp, Artificial sequence
  Affy probe set ID: 204556_s_at
ggaactaatgtccctgagatgttta

SEQ ID NO: 2082 - DNA, 25 bp, Artificial sequence
  Affy probe set ID: 204556_s_at
gactgggacatatcatccctagagg

SEQ ID NO: 2083 - DNA, 25 bp, Artificial sequence
  Affy probe set ID: 204556_s_at
gaacctccacctgcgaaaaatgaac

SEQ ID NO: 2084 - DNA, 25 bp, Artificial sequence
  Affy probe set ID: 204556_s_at
gctcatgtgctaaatgcctggggcg

SEQ ID NO: 2085 - DNA, 25 bp, Artificial sequence
  Affy probe set ID: 204556_s_at
gcctggggcgcatttaatcctaagg

SEQ ID NO: 2086 - DNA, 25 bp, Artificial sequence
  Affy probe set ID: 204556_s_at
tgtgactgattggagcgacacttca

SEQ ID NO: 2087 - DNA, 25 bp, Artificial sequence
  Affy probe set ID: 204556_s_at
aagccagcagtatttcagtatcaca

SEQ ID NO: 2088 - DNA, 25 bp, Artificial sequence
  Affy probe set ID: 204556_s_at
ccgtgtttcccacagcaacacagag

SEQ ID NO: 2089 - DNA, 25 bp, Artificial sequence
  Affy probe set ID: 204556_s_at
aatggtctctttaatggcacccaat

SEQ ID NO: 2090 - DNA, 25 bp, Artificial sequence
  Affy probe set ID: 204556_s_at
aaggtgtttaagacttccgctgctg

SEQ ID NO: 2091 - DNA, 25 bp, Artificial sequence
  Affy probe set ID: 204556_s_at
agacttccgctgctgcttaaaaata

SEQ ID NO: 2092 - DNA, 562 bp, Artificial sequence
  Target_Sequence, Fragment of GenBank Accession No. NM_001901
atcatcagatcgactcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtcttg

SEQ ID NO: 2093 - DNA, 25 bp, Artificial sequence
  Affy probe set ID: 209101_at
atcatcagatcgactcttatacgag

SEQ ID NO: 2094 - DNA, 25 bp, Artificial sequence
  Affy probe set ID: 209101_at
aaattttagcgtgctcactgacctg

SEQ ID NO: 2095 - DNA, 25 bp, Artificial sequence
  Affy probe set ID: 209101_at
agctaggatgtgcattctccagcca

SEQ ID NO: 2096 - DNA, 25 bp, Artificial sequence
  Affy probe set ID: 209101_at
agagactgagtcaagttgttcctta

SEQ ID NO: 2097 - DNA, 25 bp, Artificial sequence
  Affy probe set ID: 209101_at
agcagactcagctctgacattctga

SEQ ID NO: 2098 - DNA, 25 bp, Artificial sequence
  Affy probe set ID: 209101_at
atcggaatcctgtcgattagactgg

SEQ ID NO: 2099 - DNA, 25 bp, Artificial sequence
  Affy probe set ID: 209101_at
tagactggacagcttgtggcaagtg

SEQ ID NO: 2100 - DNA, 25 bp, Artificial sequence
  Affy probe set ID: 209101_at
gttagcctcaatttctgaacaccat

SEQ ID NO: 2101 - DNA, 25 bp, Artificial sequence
  Affy probe set ID: 209101_at
aatgtaaagcttgtctgatcgttca

SEQ ID NO: 2102 - DNA, 25 bp, Artificial sequence
  Affy probe set ID: 209101_at
gacagtccgtcaaaacagattgttt

SEQ ID NO: 2103 - DNA, 25 bp, Artificial sequence
  Affy probe set ID: 209101_at
gcaaaggggaggcatcagtgtcttg

SEQ ID NO: 2104 - DNA, 525 bp, Artificial sequence
  Target_Sequence, Fragment of GenBank Accession No. NM_024600
ctacgtggagtcaccatgctgagtcgcccttctcagcgttccatcgatgcacacctgctatcgtggaacagcctagaaaccaagggactccaccaccaagtcacttcccctgctcgtgcagaggcacgggatgagtctgggtgacctctgcgccatgcgtgcgagacacgtgtgcgtttactgttatgtcggtcatatgtctgtacgtgtcgtgggccaacctcgttctgcctccagctttcctggttagcgcaacgcggctccacgaccacacgcacttcagggtggaagctggaagctgagacacaggttaggtggcgcgaggctgccctgcgctccgctttgctttgggattaatttattctgcatctgctgagaggggcaccccagccatatcttacactttggtaaagcagaaaaccaggaaaattttcttaaaatatccacaatattccttgagtgagtcagaatctatagccggttagtgatggtttcaggcagaatcgtgttcgtgtctgttttgct

SEQ ID NO: 2105 - DNA, 25 bp, Artificial sequence
  Affy probe set ID: 219315_s_at
ctacgtggagtcaccatgctgagtc

SEQ ID NO: 2106 - DNA, 25 bp, Artificial sequence
  Affy probe set ID: 219315_s_at
cacacctgctatcgtggaacagcct

SEQ ID NO: 2107 - DNA, 25 bp, Artificial sequence
  Affy probe set ID: 219315_s_at
acgggatgagtctgggtgacctctg

SEQ ID NO: 2108 - DNA, 25 bp, Artificial sequence
  Affy probe set ID: 219315_s_at
gtgcgtttactgttatgtcggtcat

SEQ ID NO: 2109 - DNA, 25 bp, Artificial sequence
  Affy probe set ID: 219315_s_at
gtcggtcatatgtctgtacgtgtcg

SEQ ID NO: 2110 - DNA, 25 bp, Artificial sequence
  Affy probe set ID: 219315_s_at
tccagctttcctggttagcgcaacg

SEQ ID NO: 2111 - DNA, 25 bp, Artificial sequence
  Affy probe set ID: 219315_s_at
acaggttaggtggcgcgaggctgcc

SEQ ID NO: 2112 - DNA, 25 bp, Artificial sequence
  Affy probe set ID: 219315_s_at
cgctccgctttgctttgggattaat

SEQ ID NO: 2113 - DNA, 25 bp, Artificial sequence
  Affy probe set ID: 219315_s_at
tctgcatctgctgagaggggcaccc

SEQ ID NO: 2114 - DNA, 25 bp, Artificial sequence
  Affy probe set ID: 219315_s_at
ccccagccatatcttacactttggt

SEQ ID NO: 2115 - DNA, 25 bp, Artificial sequence
  Affy probe set ID: 219315_s_at
gaatcgtgttcgtgtctgttttgct

SEQ ID NO: 2116 - DNA, 412 bp, Artificial sequence
  Target_Sequence, Fragment of GenBank Accession No. NM_138370
  misc_feature (124)..(124): n is a, c, g, or t
agaatgtagctaaagcccctgctgctgctgctgcacatgccacagcaggcggtgggggctgcgtggggacaatccatcgtggagtgttctctcagcttaggtctggacaggagacttggcgggngatgctccaggatgtgggtgattctgtacctggggaggctatctctgacctcccgacaggggacactcccaggccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggtt

SEQ ID NO: 2117 - DNA, 25 bp, Artificial sequence
  Affy probe set ID: 225380_at
agaatgtagctaaagcccctgctgc

SEQ ID NO: 2118 - DNA, 25 bp, Artificial sequence
  Affy probe set ID: 225380_at
gcacatgccacagcaggcggtgggg

SEQ ID NO: 2119 - DNA, 25 bp, Artificial sequence
  Affy probe set ID: 225380_at
ctgcgtggggacaatccatcgtgga

SEQ ID NO: 2120 - DNA, 25 bp, Artificial sequence
  Affy probe set ID: 225380_at
tccatcgtggagtgttctctcagct

SEQ ID NO: 2121 - DNA, 25 bp, Artificial sequence
  Affy probe set ID: 225380_at
gtgttctctcagcttaggtctggac

SEQ ID NO: 2122 - DNA, 25 bp, Artificial sequence
  Affy probe set ID: 225380_at
gatgtgggtgattctgtacctgggg

SEQ ID NO: 2123 - DNA, 25 bp, Artificial sequence
  Affy probe set ID: 225380_at
tctgtacctggggaggctatctctg

SEQ ID NO: 2124 - DNA, 25 bp, Artificial sequence
  Affy probe set ID: 225380_at
tgcacacctcagcatgagccaagac

SEQ ID NO: 2125 - DNA, 25 bp, Artificial sequence
  Affy probe set ID: 225380_at
agcaggtgtggtttgagccaggacc

SEQ ID NO: 2126 - DNA, 25 bp, Artificial sequence
  Affy probe set ID: 225380_at
ccccttcctcgagtttgaatatcca

SEQ ID NO: 2127 - DNA, 25 bp, Artificial sequence
  Affy probe set ID: 225380_at
gaatcttttgtacttcttgttggtt

SEQ ID NO: 2128 - DNA, 356 bp, Artificial sequence
  Target_Sequence, Fragment of GenBank Accession No. NM_014632
ttagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctc

SEQ ID NO: 2129 - DNA, 25 bp, Artificial sequence
  Affy probe set ID: 212472_at
ttagagccatcatcatcccaggcag

SEQ ID NO: 2130 - DNA, 25 bp, Artificial sequence
  Affy probe set ID: 212472_at
cccctgtgactctgcttaaagcaca

SEQ ID NO: 2131 - DNA, 25 bp, Artificial sequence
  Affy probe set ID: 212472_at
agcacacatttctgctgactcttgt

SEQ ID NO: 2132 - DNA, 25 bp, Artificial sequence
  Affy probe set ID: 212472_at
agcaggataatcaccaacacactct

SEQ ID NO: 2133 - DNA, 25 bp, Artificial sequence
  Affy probe set ID: 212472_at
acgagaaacaacacaccaagcacag

SEQ ID NO: 2134 - DNA, 25 bp, Artificial sequence
  Affy probe set ID: 212472_at
acagtggagctgtcctaggcaacac

SEQ ID NO: 2135 - DNA, 25 bp, Artificial sequence
  Affy probe set ID: 212472_at
atgctgcacgctcactgtatttgtg

SEQ ID NO: 2136 - DNA, 25 bp, Artificial sequence
  Affy probe set ID: 212472_at
gtatttgtgcagatcctggccagta

SEQ ID NO: 2137 - DNA, 25 bp, Artificial sequence
  Affy probe set ID: 212472_at
ggccagtacaaagtcgttgctcttg

SEQ ID NO: 2138 - DNA, 25 bp, Artificial sequence
  Affy probe set ID: 212472_at
ctcttgtcttatcttctcttacaga

SEQ ID NO: 2139 - DNA, 25 bp, Artificial sequence
  Affy probe set ID: 212472_at
tatcttctcttacagagtctccctc

SEQ ID NO: 2140 - DNA, 479 bp, Artificial sequence
  Target_Sequence, Fragment of GenBank Accession No. NM_032866
  misc_feature (107)..(107): n is a, c, g, or t
  misc_feature (128)..(128): n is a, c, g, or t
tttgacaattgcgctatcctacactctgagggagttggcaacgcatgcggtatagtggagtgggaagagttgagactgaaagttaagagaagggttttcaagtcccngctcatctcaccccagtgacnttgacagtgtgctcactctcagagccatggattacctggaacaaagtgcagattagtgcccacggtcctttccaggtataacatgctatcgttctttaattttattatatatacatacttttcttctgttttttgctttaagaactaaccccgatcaagagtattttctttagctagcttaaaaagaaaacatatattttatgtaaaaacacatacatggccaaatgcaatactgaagagacaatcatcctgtatcttttatggtttttcctgcttctgagtgtcgttctacaatgcccgttgacttattccattgcgtctctgctttagggtatggtttggtcgctttgg

SEQ ID NO: 2141 - DNA, 25 bp, Artificial sequence
  Affy probe set ID: 225817_at
tttgacaattgcgctatcctacact

SEQ ID NO: 2142 - DNA, 25 bp, Artificial sequence
  Affy probe set ID: 225817_at
gagggagttggcaacgcatgcggta

SEQ ID NO: 2143 - DNA, 25 bp, Artificial sequence
  Affy probe set ID: 225817_at
ttgacagtgtgctcactctcagagc

SEQ ID NO: 2144 - DNA, 25 bp, Artificial sequence
  Affy probe set ID: 225817_at
tcactctcagagccatggattacct

SEQ ID NO: 2145 - DNA, 25 bp, Artificial sequence
  Affy probe set ID: 225817_at
aaagtgcagattagtgcccacggtc

SEQ ID NO: 2146 - DNA, 25 bp, Artificial sequence
  Affy probe set ID: 225817_at
ccacggtcctttccaggtataacat

SEQ ID NO: 2147 - DNA, 25 bp, Artificial sequence
  Affy probe set ID: 225817_at
gagacaatcatcctgtatcttttat

SEQ ID NO: 2148 - DNA, 25 bp, Artificial sequence
  Affy probe set ID: 225817_at
tctgagtgtcgttctacaatgcccg

SEQ ID NO: 2149 - DNA, 25 bp, Artificial sequence
  Affy probe set ID: 225817_at
gcccgttgacttattccattgcgtc

SEQ ID NO: 2150 - DNA, 25 bp, Artificial sequence
  Affy probe set ID: 225817_at
tccattgcgtctctgctttagggta

SEQ ID NO: 2151 - DNA, 25 bp, Artificial sequence
  Affy probe set ID: 225817_at
ttagggtatggtttggtcgctttgg

SEQ ID NO: 2152 - DNA, 238 bp, Artificial sequence
  Target_Sequence, Fragment of GenBank Accession No. NM_003687
ctgggctccgaggtgtacaggatgctgcgggagccggccgagcccgtggccgcggagcccaagcagtcaggctccttccgctacttgcagggcatgctagaggccggcgagggcggggcaccatcgtcaaggcacgggacaagctctaccatcccgagtgcttcatgtgcagtgactgcggcctgaacctcaagcagcgtggttacttctttctggacgagcggctctactgtgagag

SEQ ID NO: 2153 - DNA, 25 bp, Artificial sequence
  Affy probe set ID: 211564_s_at
ctgggctccgaggtgtacaggatgc

SEQ ID NO: 2154 - DNA, 25 bp, Artificial sequence
  Affy probe set ID: 211564_s_at
ggctccgaggtgtacaggatgctgc

SEQ ID NO: 2155 - DNA, 25 bp, Artificial sequence
  Affy probe set ID: 211564_s_at
tccgctacttgcagggcatgctaga

SEQ ID NO: 2156 - DNA, 25 bp, Artificial sequence
  Affy probe set ID: 211564_s_at
gctacttgcagggcatgctagaggc

SEQ ID NO: 2157 - DNA, 25 bp, Artificial sequence
  Affy probe set ID: 211564_s_at
tgcagggcatgctagaggccggcga

SEQ ID NO: 2158 - DNA, 25 bp, Artificial sequence
  Affy probe set ID: 211564_s_at
catcccgagtgcttcatgtgcagtg

SEQ ID NO: 2159 - DNA, 25 bp, Artificial sequence
  Affy probe set ID: 211564_s_at
gagtgcttcatgtgcagtgactgcg

SEQ ID NO: 2160 - DNA, 25 bp, Artificial sequence
  Affy probe set ID: 211564_s_at
gcttcatgtgcagtgactgcggcct

SEQ ID NO: 2161 - DNA, 25 bp, Artificial sequence
  Affy probe set ID: 211564_s_at
atgtgcagtgactgcggcctgaacc

SEQ ID NO: 2162 - DNA, 25 bp, Artificial sequence
  Affy probe set ID: 211564_s_at
tctttctggacgagcggctctactg

SEQ ID NO: 2163 - DNA, 25 bp, Artificial sequence
  Affy probe set ID: 211564_s_at
tggacgagcggctctactgtgagag

SEQ ID NO: 2164 - DNA, 448 bp, Artificial sequence
  Target_Sequence, Fragment of GenBank Accession No. BM544548
  misc_feature (27)..(27): n is a, c, g, or t
  misc_feature (384)..(384): n is a, c, g, or t
  misc_feature (402)..(402): n is a, c, g, or t
gcattgaaatcaaattgggctgaacanttcaatggaatacattttgtggacaatgtcactttagaatctttcatctcagtgaaggattacacattctcaatacttccataattgcaggttgtgttcatttttttatatagtttttgtaatccaaagaatattttgctagatttgcacagatctccaattgaatttgcaatgaagaaataactcaaaaggaatatgaatagcatttaaataagtatacagctgtaagtaaccctgtcaccatggatgatccttttctctaggaatgtatttggattagagatgacaactacattttcgcatttttatgttgaagtcttttttaaaaaggctgtttacttttcagtagttaagaanacttgtttttctttttcntttttttttttttttaccttttattttttcgttaagcctctattgt

SEQ ID NO: 2165 - DNA, 25 bp, Artificial sequence
  Affy probe set ID: 236179_at
gcattgaaatcaaattgggctgaac

SEQ ID NO: 2166 - DNA, 25 bp, Artificial sequence
  Affy probe set ID: 236179_at
cattttgtggacaatgtcactttag

SEQ ID NO: 2167 - DNA, 25 bp, Artificial sequence
  Affy probe set ID: 236179_at
atacttccataattgcaggttgtgt

SEQ ID NO: 2168 - DNA, 25 bp, Artificial sequence
  Affy probe set ID: 236179_at
tttgctagatttgcacagatctcca

SEQ ID NO: 2169 - DNA, 25 bp, Artificial sequence
  Affy probe set ID: 236179_at
gcacagatctccaattgaatttgca

SEQ ID NO: 2170 - DNA, 25 bp, Artificial sequence
  Affy probe set ID: 236179_at
cagctgtaagtaaccctgtcaccat

SEQ ID NO: 2171 - DNA, 25 bp, Artificial sequence
  Affy probe set ID: 236179_at
gtaagtaaccctgtcaccatggatg

SEQ ID NO: 2172 - DNA, 25 bp, Artificial sequence
  Affy probe set ID: 236179_at
ggatgatccttttctctaggaatgt

SEQ ID NO: 2173 - DNA, 25 bp, Artificial sequence
  Affy probe set ID: 236179_at
gagatgacaactacattttcgcatt

SEQ ID NO: 2174 - DNA, 25 bp, Artificial sequence
  Affy probe set ID: 236179_at
attttcgcatttttatgttgaagtc

SEQ ID NO: 2175 - DNA, 25 bp, Artificial sequence
  Affy probe set ID: 236179_at
tattttttcgttaagcctctattgt

SEQ ID NO: 2176 - DNA, 468 bp, Artificial sequence
  Target_Sequence, Fragment of GenBank Accession No. NM_001856
ggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttttttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaagggcatttgggtacaggggcatatacctgtaatcctagctattcaaggggctgag

SEQ ID NO: 2177 - DNA, 25 bp, Artificial sequence
  Affy probe set ID: 204345_at
ggtgcaacaggaccaatgggccagc

SEQ ID NO: 2178 - DNA, 25 bp, Artificial sequence
  Affy probe set ID: 204345_at
gaccaatgggccagcaaggcatccc

SEQ ID NO: 2179 - DNA, 25 bp, Artificial sequence
  Affy probe set ID: 204345_at
caggcaaggctggccactgtaatcc

SEQ ID NO: 2180 - DNA, 25 bp, Artificial sequence
  Affy probe set ID: 204345_at
ctttggggccatgccgatggagcag

SEQ ID NO: 2181 - DNA, 25 bp, Artificial sequence
  Affy probe set ID: 204345_at
catgccgatggagcagcagtaccca

SEQ ID NO: 2182 - DNA, 25 bp, Artificial sequence
  Affy probe set ID: 204345_at
aaccatgaaggggccttttggctga

SEQ ID NO: 2183 - DNA, 25 bp, Artificial sequence
  Affy probe set ID: 204345_at
agactccgttgggaataaatggcca

SEQ ID NO: 2184 - DNA, 25 bp, Artificial sequence
  Affy probe set ID: 204345_at
ggccaaagcttataggactctgtga

SEQ ID NO: 2185 - DNA, 25 bp, Artificial sequence
  Affy probe set ID: 204345_at
gactctgtgacaggttgtgaatgtt

SEQ ID NO: 2186 - DNA, 25 bp, Artificial sequence
  Affy probe set ID: 204345_at
aagggcatttgggtacaggggcata

SEQ ID NO: 2187 - DNA, 25 bp, Artificial sequence
  Affy probe set ID: 204345_at
aatcctagctattcaaggggctgag

SEQ ID NO: 2188 - DNA, 527 bp, Artificial sequence
  Target_Sequence, Fragment of GenBank Accession No. XM_087386
aagcgacaggtccgagactgggtctgtcacctgggcattttcaaagaggacattttgaagaatttgcatattcagatttttaaaatgcacttaacatacttcattacagatttcttgggtagggaggatgggataggccagggatgggatggaatcagttctgcctgggaaactaatccgaatcatttacctttctgtattaaccttggcctgtcctaaaaagagaacgactgtttcatcatgagttgctctgagttttgttaatgtttgtgttggtggattgacggttaaatgaagcatttagctggaatatgaactttgggagttttcatgttgtcctggatttctctttgtaaacctttaaaccttagcccctggttgattgtgttaaacccattatgagaatgttatttaaagttgtattataattgcaacctccactaattattcagtactgtagcagcaaagtattatttgtaagaatttggttatttttatacttatatccactctaagtctggcgttct

SEQ ID NO: 2189 - DNA, 25 bp, Artificial sequence
  Affy probe set ID: 213069_at
aagcgacaggtccgagactgggtct

SEQ ID NO: 2190 - DNA, 25 bp, Artificial sequence
  Affy probe set ID: 213069_at
tgcacttaacatacttcattacaga

SEQ ID NO: 2191 - DNA, 25 bp, Artificial sequence
  Affy probe set ID: 213069_at
gatgggatggaatcagttctgcctg

SEQ ID NO: 2192 - DNA, 25 bp, Artificial sequence
  Affy probe set ID: 213069_at
gttctgcctgggaaactaatccgaa

SEQ ID NO: 2193 - DNA, 25 bp, Artificial sequence
  Affy probe set ID: 213069_at
taatccgaatcatttacctttctgt

SEQ ID NO: 2194 - DNA, 25 bp, Artificial sequence
  Affy probe set ID: 213069_at
tacctttctgtattaaccttggcct

SEQ ID NO: 2195 - DNA, 25 bp, Artificial sequence
  Affy probe set ID: 213069_at
taaccttggcctgtcctaaaaagag

SEQ ID NO: 2196 - DNA, 25 bp, Artificial sequence
  Affy probe set ID: 213069_at
gactgtttcatcatgagttgctctg

SEQ ID NO: 2197 - DNA, 25 bp, Artificial sequence
  Affy probe set ID: 213069_at
ccttagcccctggttgattgtgtta

SEQ ID NO: 2198 - DNA, 25 bp, Artificial sequence
  Affy probe set ID: 213069_at
attgcaacctccactaattattcag

SEQ ID NO: 2199 - DNA, 25 bp, Artificial sequence
  Affy probe set ID: 213069_at
atatccactctaagtctggcgttct

SEQ ID NO: 2200 - DNA, 542 bp, Artificial sequence
  Target_Sequence, Fragment of GenBank Accession No. NM_003887
ctccagtcccaaactaatctgtcaggttcactggtacataaatacctaggaaatatttttccagtctacaatttggtgctattgtgcagtaactaatagtactcttaccagaggagaaattatattaacgaccctgctaatatcctttcttagttatttgctccttgcaaattaaaaaagcaactaagagaaagaaaaacattgtagatatctatttatatttaaagtttatgtttcatgaactgcagctgcaggattctggcattttgcatgccattctccatcagatctgggatgatggctcagaacatgtacacagactaagagtaactgtgtgatctgttaaggggtggataacataatatgcagcttaggatgctattttgagatgtatgatattcagttcattcacctgattactttggttgcagcacaactgtatatattgtataaccgaaattgattattttcattgtccttaatgcagtgatttataattagagcatgtttaataagtttactcttcttgttaactagtcatt

SEQ ID NO: 2201 - DNA, 25 bp, Artificial sequence
  Affy probe set ID: 206414_s_at
ctccagtcccaaactaatctgtcag

SEQ ID NO: 2202 - DNA, 25 bp, Artificial sequence
  Affy probe set ID: 206414_s_at
aatctgtcaggttcactggtacata

SEQ ID NO: 2203 - DNA, 25 bp, Artificial sequence
  Affy probe set ID: 206414_s_at
gaaattatattaacgaccctgctaa

SEQ ID NO: 2204 - DNA, 25 bp, Artificial sequence
  Affy probe set ID: 206414_s_at
gaccctgctaatatcctttcttagt

SEQ ID NO: 2205 - DNA, 25 bp, Artificial sequence
  Affy probe set ID: 206414_s_at
ctttcttagttatttgctccttgca

SEQ ID NO: 2206 - DNA, 25 bp, Artificial sequence
  Affy probe set ID: 206414_s_at
cagctgcaggattctggcattttgc

SEQ ID NO: 2207 - DNA, 25 bp, Artificial sequence
  Affy probe set ID: 206414_s_at
ggcattttgcatgccattctccatc

SEQ ID NO: 2208 - DNA, 25 bp, Artificial sequence
  Affy probe set ID: 206414_s_at
gatggctcagaacatgtacacagac

SEQ ID NO: 2209 - DNA, 25 bp, Artificial sequence
  Affy probe set ID: 206414_s_at
gatattcagttcattcacctgatta

SEQ ID NO: 2210 - DNA, 25 bp, Artificial sequence
  Affy probe set ID: 206414_s_at
cacctgattactttggttgcagcac

SEQ ID NO: 2211 - DNA, 25 bp, Artificial sequence
  Affy probe set ID: 206414_s_at
ttactcttcttgttaactagtcatt

SEQ ID NO: 2212 - DNA, 403 bp, Artificial sequence
  Target_Sequence, Fragment of GenBank Accession No. NM_002844
aaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatga

SEQ ID NO: 2213 - DNA, 25 bp, Artificial sequence
  Affy probe set ID: 203038_at
aaggccttgctgacaacttgcacaa

SEQ ID NO: 2214 - DNA, 25 bp, Artificial sequence
  Affy probe set ID: 203038_at
gaatggagtttttcagcctgtggcc

SEQ ID NO: 2215 - DNA, 25 bp, Artificial sequence
  Affy probe set ID: 203038_at
cctgtggcccagcactggtcaagaa

SEQ ID NO: 2216 - DNA, 25 bp, Artificial sequence
  Affy probe set ID: 203038_at
catgcacaagctttgcgttctgact

SEQ ID NO: 2217 - DNA, 25 bp, Artificial sequence
  Affy probe set ID: 203038_at
caatgccagattcctgttttgcgca

SEQ ID NO: 2218 - DNA, 25 bp, Artificial sequence
  Affy probe set ID: 203038_at
gttttgcgcattgtcatgggattct

SEQ ID NO: 2219 - DNA, 25 bp, Artificial sequence
  Affy probe set ID: 203038_at
tgtggtcttgttcacatgctccacg

SEQ ID NO: 2220 - DNA, 25 bp, Artificial sequence
  Affy probe set ID: 203038_at
atgctccacgtagctgtaacttcac

SEQ ID NO: 2221 - DNA, 25 bp, Artificial sequence
  Affy probe set ID: 203038_at
gtaacttcacatcatcagcttgcag

SEQ ID NO: 2222 - DNA, 25 bp, Artificial sequence
  Affy probe set ID: 203038_at
attgactaaagcattccagtgtcct

SEQ ID NO: 2223 - DNA, 25 bp, Artificial sequence
  Affy probe set ID: 203038_at
ctctttctagattgccagctcatga

SEQ ID NO: 2224 - DNA, 377 bp, Artificial sequence
  Target_Sequence, Fragment of GenBank Accession No. NM_022138
agggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacag

SEQ ID NO: 2225 - DNA, 25 bp, Artificial sequence
  Affy probe set ID: 223235_s_at
agggtacgagaacttgccaatggga

SEQ ID NO: 2226 - DNA, 25 bp, Artificial sequence
  Affy probe set ID: 223235_s_at
gaaattcatccgagtggcactggca

SEQ ID NO: 2227 - DNA, 25 bp, Artificial sequence
  Affy probe set ID: 223235_s_at
ctggtctgcgtgcataaccagctgc

SEQ ID NO: 2228 - DNA, 25 bp, Artificial sequence
  Affy probe set ID: 223235_s_at
ggcacccagtgtcttaaggaaccat

SEQ ID NO: 2229 - DNA, 25 bp, Artificial sequence
  Affy probe set ID: 223235_s_at
caagctgtgattctatctcggctca

SEQ ID NO: 2230 - DNA, 25 bp, Artificial sequence
  Affy probe set ID: 223235_s_at
tatctcggctcagacttttggttgg

SEQ ID NO: 2231 - DNA, 25 bp, Artificial sequence
  Affy probe set ID: 223235_s_at
aaaagatcttcatggccccaaatcc

SEQ ID NO: 2232 - DNA, 25 bp, Artificial sequence
  Affy probe set ID: 223235_s_at
atcccctgagacatgccttgtagaa

SEQ ID NO: 2233 - DNA, 25 bp, Artificial sequence
  Affy probe set ID: 223235_s_at
tggagcatcgcgtaaggcttcttgc

SEQ ID NO: 2234 - DNA, 25 bp, Artificial sequence
  Affy probe set ID: 223235_s_at
ggcttcttgcttatttaaactgtgc

SEQ ID NO: 2235 - DNA, 25 bp, Artificial sequence
  Affy probe set ID: 223235_s_at
aaaaatcaagcctttggagccacag

SEQ ID NO: 2236 - DNA, 531 bp, Artificial sequence
  Target_Sequence, Fragment of GenBank Accession No. NM_001006624
gtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggtttcattggtggaatcatcgttgtggttatgcgaaaaatgtcgggaaggtactcgccctaaagagctgaagggttacgccctgcttgccaacgtgctttaaaaaaagaccgtttctgactctgtggccctgtccctgagctcgtggggagaagatgaccctgggaacatttgcgggcccattcagattccacggtgactttccgtttgc

SEQ ID NO: 2237 - DNA, 25 bp, Artificial sequence
  Affy probe set ID: 204879_at
gtttggaaggcggcgttgccatgcc

SEQ ID NO: 2238 - DNA, 25 bp, Artificial sequence
  Affy probe set ID: 204879_at
ttgccatgccaggtgccgaagatga

SEQ ID NO: 2239 - DNA, 25 bp, Artificial sequence
  Affy probe set ID: 204879_at
tgactccaggaaccagcgaagaccg

SEQ ID NO: 2240 - DNA, 25 bp, Artificial sequence
  Affy probe set ID: 204879_at
gcattcgcatcgaggatctgccaac

SEQ ID NO: 2241 - DNA, 25 bp, Artificial sequence
  Affy probe set ID: 204879_at
ttcagaaagcacagtccacgcgcaa

SEQ ID NO: 2242 - DNA, 25 bp, Artificial sequence
  Affy probe set ID: 204879_at
aagcgccacagcctcaaacgtggcc

SEQ ID NO: 2243 - DNA, 25 bp, Artificial sequence
  Affy probe set ID: 204879_at
gaaggtactcgccctaaagagctga

SEQ ID NO: 2244 - DNA, 25 bp, Artificial sequence
  Affy probe set ID: 204879_at
agagctgaagggttacgccctgctt

SEQ ID NO: 2245 - DNA, 25 bp, Artificial sequence
  Affy probe set ID: 204879_at
aaaagaccgtttctgactctgtggc

SEQ ID NO: 2246 - DNA, 25 bp, Artificial sequence
  Affy probe set ID: 204879_at
aacatttgcgggcccattcagattc

SEQ ID NO: 2247 - DNA, 25 bp, Artificial sequence
  Affy probe set ID: 204879_at
gattccacggtgactttccgtttgc

SEQ ID NO: 2248 - DNA, 325 bp, Artificial sequence
  Target_Sequence, Fragment of GenBank Accession No. NM_003174
atatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatgg

SEQ ID NO: 2249 - DNA, 25 bp, Artificial sequence
  Affy probe set ID: 202565_s_at
atatgtattcattcactttcaagat

SEQ ID NO: 2250 - DNA, 25 bp, Artificial sequence
  Affy probe set ID: 202565_s_at
cttctgttgaattagctctgccacc

SEQ ID NO: 2251 - DNA, 25 bp, Artificial sequence
  Affy probe set ID: 202565_s_at
agctctgccaccaatatgtatcttc

SEQ ID NO: 2252 - DNA, 25 bp, Artificial sequence
  Affy probe set ID: 202565_s_at
gtatcttcatacacgtttggaaatg

SEQ ID NO: 2253 - DNA, 25 bp, Artificial sequence
  Affy probe set ID: 202565_s_at
ggaaatgtttcctgcagcattaggt

SEQ ID NO: 2254 - DNA, 25 bp, Artificial sequence
  Affy probe set ID: 202565_s_at
gcattaggtatgacttgttctgagt

SEQ ID NO: 2255 - DNA, 25 bp, Artificial sequence
  Affy probe set ID: 202565_s_at
tgagtactgcttccggtgctaaaat

SEQ ID NO: 2256 - DNA, 25 bp, Artificial sequence
  Affy probe set ID: 202565_s_at
ttaatggcatggactctggagaatc

SEQ ID NO: 2257 - DNA, 25 bp, Artificial sequence
  Affy probe set ID: 202565_s_at
tatgcgaatcaacctttctacctta

SEQ ID NO: 2258 - DNA, 25 bp, Artificial sequence
  Affy probe set ID: 202565_s_at
tctaccttaatatctccccaaaaat

SEQ ID NO: 2259 - DNA, 25 bp, Artificial sequence
  Affy probe set ID: 202565_s_at
gtttgctctgcatttttgatgatgg

SEQ ID NO: 2260 - DNA, 383 bp, Artificial sequence
  Target_Sequence, Fragment of GenBank Accession No. NM_002845
gagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgt

SEQ ID NO: 2261 - DNA, 25 bp, Artificial sequence
  Affy probe set ID: 1555579_s_at
gagcagcgtagacagctggtaaact

SEQ ID NO: 2262 - DNA, 25 bp, Artificial sequence
  Affy probe set ID: 1555579_s_at
gagcacaactatattcttatgaagg

SEQ ID NO: 2263 - DNA, 25 bp, Artificial sequence
  Affy probe set ID: 1555579_s_at
gtattattttgtggcccgtgaccct

SEQ ID NO: 2264 - DNA, 25 bp, Artificial sequence
  Affy probe set ID: 1555579_s_at
tggcccgtgaccctcgttattgtta

SEQ ID NO: 2265 - DNA, 25 bp, Artificial sequence
  Affy probe set ID: 1555579_s_at
acagctgagtgtatgtttttgttct

SEQ ID NO: 2266 - DNA, 25 bp, Artificial sequence
  Affy probe set ID: 1555579_s_at
gttctgtggagaatgctatctggca

SEQ ID NO: 2267 - DNA, 25 bp, Artificial sequence
  Affy probe set ID: 1555579_s_at
atatgcttatgtagctttccaggac

SEQ ID NO: 2268 - DNA, 25 bp, Artificial sequence
  Affy probe set ID: 1555579_s_at
gtagctttccaggactaacagataa

SEQ ID NO: 2269 - DNA, 25 bp, Artificial sequence
  Affy probe set ID: 1555579_s_at
ggaggactcagttcacaaaatgcaa

SEQ ID NO: 2270 - DNA, 25 bp, Artificial sequence
  Affy probe set ID: 1555579_s_at
aacgatcagattcacggacccagag

SEQ ID NO: 2271 - DNA, 25 bp, Artificial sequence
  Affy probe set ID: 1555579_s_at
acggacccagagcttttccatgtgt

SEQ ID NO: 2272 - DNA, 499 bp, Artificial sequence
  Target_Sequence, Fragment of GenBank Accession No. NM_002889
tggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagctgcgtggtgcctccaggaccgctgccggtggtaaccagtggaagaccccagcccccagggagaggaccccgttctatccccagccatgataata

SEQ ID NO: 2273 - DNA, 25 bp, Artificial sequence
  Affy probe set ID: 209496_at
tggaggaatttcacaagcacccgcc

SEQ ID NO: 2274 - DNA, 25 bp, Artificial sequence
  Affy probe set ID: 209496_at
cgcccttcccagctggaatatttgt

SEQ ID NO: 2275 - DNA, 25 bp, Artificial sequence
  Affy probe set ID: 209496_at
cagcagacaagctgccggaagaggg

SEQ ID NO: 2276 - DNA, 25 bp, Artificial sequence
  Affy probe set ID: 209496_at
gagggactggaagaaacccgagtgc

SEQ ID NO: 2277 - DNA, 25 bp, Artificial sequence
  Affy probe set ID: 209496_at
aaacccgagtgcaaagtcaggccca

SEQ ID NO: 2278 - DNA, 25 bp, Artificial sequence
  Affy probe set ID: 209496_at
ctgcatcaaactgggctctgaggac

SEQ ID NO: 2279 - DNA, 25 bp, Artificial sequence
  Affy probe set ID: 209496_at
ccccatagagacccaagttctgcgg

SEQ ID NO: 2280 - DNA, 25 bp, Artificial sequence
  Affy probe set ID: 209496_at
gagacccaagttctgcgggaggctg

SEQ ID NO: 2281 - DNA, 25 bp, Artificial sequence
  Affy probe set ID: 209496_at
agggtgcagcgggctggtgaggacc

SEQ ID NO: 2282 - DNA, 25 bp, Artificial sequence
  Affy probe set ID: 209496_at
agccagcactgagctgcgtggtgcc

SEQ ID NO: 2283 - DNA, 25 bp, Artificial sequence
  Affy probe set ID: 209496_at
cgttctatccccagccatgataata

SEQ ID NO: 2284 - DNA, 524 bp, Artificial sequence
  Target_Sequence, Fragment of GenBank Accession No. NM_006094
aaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgta

SEQ ID NO: 2285 - DNA, 25 bp, Artificial sequence
  Affy probe set ID: 210762_s_at
aaaacagtatggcacctcatcctgc

SEQ ID NO: 2286 - DNA, 25 bp, Artificial sequence
  Affy probe set ID: 210762_s_at
tcatcctgctcgagactacgttgtt

SEQ ID NO: 2287 - DNA, 25 bp, Artificial sequence
  Affy probe set ID: 210762_s_at
ctaacctctgtggatcacgatcgcg

SEQ ID NO: 2288 - DNA, 25 bp, Artificial sequence
  Affy probe set ID: 210762_s_at
gttaatgtgctcttgtccaggtatt

SEQ ID NO: 2289 - DNA, 25 bp, Artificial sequence
  Affy probe set ID: 210762_s_at
gggccaggaaaatccaaactcacct

SEQ ID NO: 2290 - DNA, 25 bp, Artificial sequence
  Affy probe set ID: 210762_s_at
agatccgggattccttcagtaacca

SEQ ID NO: 2291 - DNA, 25 bp, Artificial sequence
  Affy probe set ID: 210762_s_at
gtgatcactgaagcaacgcaaccgc

SEQ ID NO: 2292 - DNA, 25 bp, Artificial sequence
  Affy probe set ID: 210762_s_at
accaccatggtgtttgtttctagaa

SEQ ID NO: 2293 - DNA, 25 bp, Artificial sequence
  Affy probe set ID: 210762_s_at
agaacttttgccagtccttgaagaa

SEQ ID NO: 2294 - DNA, 25 bp, Artificial sequence
  Affy probe set ID: 210762_s_at
gaatgggttctgtgtctaatcctga

SEQ ID NO: 2295 - DNA, 25 bp, Artificial sequence
  Affy probe set ID: 210762_s_at
gcttcctgtttgttgagggtctgta

SEQ ID NO: 2296 - DNA, 413 bp, Artificial sequence
  Target_Sequence, Fragment of GenBank Accession No. NM_022463
ccttttcctaagcaccagcggaaggagctgtgccccgggatggagtgagggtggagggcgcgtcagccacgggtgggccttgtgtcgcctcgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaat

SEQ ID NO: 2297 - DNA, 25 bp, Artificial sequence
  Affy probe set ID: 219489_s_at
ccttttcctaagcaccagcggaagg

SEQ ID NO: 2298 - DNA, 25 bp, Artificial sequence
  Affy probe set ID: 219489_s_at
gtatcggcccaggtaggttgttggc

SEQ ID NO: 2299 - DNA, 25 bp, Artificial sequence
  Affy probe set ID: 219489_s_at
ttgttggcctcttacttgggctgac

SEQ ID NO: 2300 - DNA, 25 bp, Artificial sequence
  Affy probe set ID: 219489_s_at
tgacctgacccccgaaagagaaaca

SEQ ID NO: 2301 - DNA, 25 bp, Artificial sequence
  Affy probe set ID: 219489_s_at
ggccaagcgttttagcctcattcac

SEQ ID NO: 2302 - DNA, 25 bp, Artificial sequence
  Affy probe set ID: 219489_s_at
cccacccgctaatgagctgttgaca

SEQ ID NO: 2303 - DNA, 25 bp, Artificial sequence
  Affy probe set ID: 219489_s_at
agctgttgacactgttgttccttgc

SEQ ID NO: 2304 - DNA, 25 bp, Artificial sequence
  Affy probe set ID: 219489_s_at
gttgacttgtagttcagaggcgtac

SEQ ID NO: 2305 - DNA, 25 bp, Artificial sequence
  Affy probe set ID: 219489_s_at
gacttgttatgtgatgttaccagcc

SEQ ID NO: 2306 - DNA, 25 bp, Artificial sequence
  Affy probe set ID: 219489_s_at
gttaccagcctgaaatgcgatcacc

SEQ ID NO: 2307 - DNA, 25 bp, Artificial sequence
  Affy probe set ID: 219489_s_at
gaaatgcgatcaccccgtaggaaat

SEQ ID NO: 2308 - DNA, 433 bp, Artificial sequence
  Target_Sequence, Fragment of GenBank Accession No. AK027294
gacatgattgtctataatctcgctagccttgtactgtgtgtgcatagcaattacagggaagtaatctagctcctgactattatgttgaactatgtcgctgctttttacaaacttgtcttgatccaaagcagtcacaatgataaccctgcatatctgggaatcataagtcaactatgtatctctgtgtgtgtatatatatgtatgtatgtatctattttcaaactgtgatttaatatttaaatattcctactgccatttttgtgactgaaaaactacacatgaggaaacgtcttagaattttccaatagaggaaaaataacacttgggcaatctgtcatgtttcacaacagttctcatttttctcatgatttgtgtagcgtggaatgtgtttgctcaatgtgaagggttttcattgctcaatttctctgtgtaa

SEQ ID NO: 2309 - DNA, 25 bp, Artificial sequence
  Affy probe set ID: 229802_at
gacatgattgtctataatctcgcta

SEQ ID NO: 2310 - DNA, 25 bp, Artificial sequence
  Affy probe set ID: 229802_at
taatctcgctagccttgtactgtgt

SEQ ID NO: 2311 - DNA, 25 bp, Artificial sequence
  Affy probe set ID: 229802_at
ggaagtaatctagctcctgactatt

SEQ ID NO: 2312 - DNA, 25 bp, Artificial sequence
  Affy probe set ID: 229802_at
gttgaactatgtcgctgctttttac

SEQ ID NO: 2313 - DNA, 25 bp, Artificial sequence
  Affy probe set ID: 229802_at
acttgtcttgatccaaagcagtcac

SEQ ID NO: 2314 - DNA, 25 bp, Artificial sequence
  Affy probe set ID: 229802_at
gataaccctgcatatctgggaatca

SEQ ID NO: 2315 - DNA, 25 bp, Artificial sequence
  Affy probe set ID: 229802_at
cctactgccatttttgtgactgaaa

SEQ ID NO: 2316 - DNA, 25 bp, Artificial sequence
  Affy probe set ID: 229802_at
acttgggcaatctgtcatgtttcac

SEQ ID NO: 2317 - DNA, 25 bp, Artificial sequence
  Affy probe set ID: 229802_at
tcacaacagttctcatttttctcat

SEQ ID NO: 2318 - DNA, 25 bp, Artificial sequence
  Affy probe set ID: 229802_at
ttttctcatgatttgtgtagcgtgg

SEQ ID NO: 2319 - DNA, 25 bp, Artificial sequence
  Affy probe set ID: 229802_at
ttcattgctcaatttctctgtgtaa

SEQ ID NO: 2320 - DNA, 575 bp, Artificial sequence
  Target_Sequence, Fragment of GenBank Accession No. NM_005711
gatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaa

SEQ ID NO: 2321 - DNA, 25 bp, Artificial sequence
  Affy probe set ID: 225275_at
gatgagagcaaaggggtcgcaccat

SEQ ID NO: 2322 - DNA, 25 bp, Artificial sequence
  Affy probe set ID: 225275_at
ggggtcgcaccatatggaaatgttg

SEQ ID NO: 2323 - DNA, 25 bp, Artificial sequence
  Affy probe set ID: 225275_at
gaatcacctagtcttcactatattg

SEQ ID NO: 2324 - DNA, 25 bp, Artificial sequence
  Affy probe set ID: 225275_at
ctaaacttttaaacatctccattat

SEQ ID NO: 2325 - DNA, 25 bp, Artificial sequence
  Affy probe set ID: 225275_at
tctccattatatctacatccttttg

SEQ ID NO: 2326 - DNA, 25 bp, Artificial sequence
  Affy probe set ID: 225275_at
gaaggtatttatcatagttgccaat

SEQ ID NO: 2327 - DNA, 25 bp, Artificial sequence
  Affy probe set ID: 225275_at
gtatctttgctagtcaacaacttat

SEQ ID NO: 2328 - DNA, 25 bp, Artificial sequence
  Affy probe set ID: 225275_at
atactcaatgcgtctgatgtgtcat

SEQ ID NO: 2329 - DNA, 25 bp, Artificial sequence
  Affy probe set ID: 225275_at
ataacctttgcaaaccttcaagctg

SEQ ID NO: 2330 - DNA, 25 bp, Artificial sequence
  Affy probe set ID: 225275_at
accagtatgaccttgtctagtctcc

SEQ ID NO: 2331 - DNA, 25 bp, Artificial sequence
  Affy probe set ID: 225275_at
gaccttgtctagtctccaaacttaa

SEQ ID NO: 2332 - DNA, 358 bp, Artificial sequence
  Target_Sequence, Fragment of GenBank Accession No. NM_000177
tgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgt

SEQ ID NO: 2333 - DNA, 25 bp, Artificial sequence
  Affy probe set ID: 200696_s_at
tgcttctggacacctgggaccaggt

SEQ ID NO: 2334 - DNA, 25 bp, Artificial sequence
  Affy probe set ID: 200696_s_at
gggaccaggtctttgtctgggttgg

SEQ ID NO: 2335 - DNA, 25 bp, Artificial sequence
  Affy probe set ID: 200696_s_at
gaagccttgacttctgctaagcggt

SEQ ID NO: 2336 - DNA, 25 bp, Artificial sequence
  Affy probe set ID: 200696_s_at
taagcggtacatcgagacggaccca

SEQ ID NO: 2337 - DNA, 25 bp, Artificial sequence
  Affy probe set ID: 200696_s_at
tgaagcaaggctttgagcctccctc

SEQ ID NO: 2338 - DNA, 25 bp, Artificial sequence
  Affy probe set ID: 200696_s_at
gctggttccttggctgggatgatga

SEQ ID NO: 2339 - DNA, 25 bp, Artificial sequence
  Affy probe set ID: 200696_s_at
tgattactggtctgtggaccccttg

SEQ ID NO: 2340 - DNA, 25 bp, Artificial sequence
  Affy probe set ID: 200696_s_at
tcaccggtcagtgccttttggaact

SEQ ID NO: 2341 - DNA, 25 bp, Artificial sequence
  Affy probe set ID: 200696_s_at
ctgtccttccctcaaagaggcctta

SEQ ID NO: 2342 - DNA, 25 bp, Artificial sequence
  Affy probe set ID: 200696_s_at
agaggccttagagcgagcagagcag

SEQ ID NO: 2343 - DNA, 25 bp, Artificial sequence
  Affy probe set ID: 200696_s_at
gagcagctctgctatgagtgtgtgt

SEQ ID NO: 2344 - DNA, 477 bp, Artificial sequence
  Target_Sequence, Fragment of GenBank Accession No. NM_016639
gcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttccttaggacctgggggccaggctgacttggggggcagacttgacactaggccccactcactcagatgtcctgaaattccaccacgggggtcaccctggggggttagggacctatttttaacactaggggctggcccactaggagggctggccctaagatacagaccc

SEQ ID NO: 2345 - DNA, 25 bp, Artificial sequence
  Affy probe set ID: 218368_s_at
gcgctgatccagtgacaatgtgccc

SEQ ID NO: 2346 - DNA, 25 bp, Artificial sequence
  Affy probe set ID: 218368_s_at
cattcatccattctagagccagtct

SEQ ID NO: 2347 - DNA, 25 bp, Artificial sequence
  Affy probe set ID: 218368_s_at
gctcctccaaccacaaggggggtgg

SEQ ID NO: 2348 - DNA, 25 bp, Artificial sequence
  Affy probe set ID: 218368_s_at
caggggaaccttccaaggtgtctgg

SEQ ID NO: 2349 - DNA, 25 bp, Artificial sequence
  Affy probe set ID: 218368_s_at
cctgcctctggctccagaacagaaa

SEQ ID NO: 2350 - DNA, 25 bp, Artificial sequence
  Affy probe set ID: 218368_s_at
agaaagggagcctcacgctggctca

SEQ ID NO: 2351 - DNA, 25 bp, Artificial sequence
  Affy probe set ID: 218368_s_at
gcagcatttgcacaggggagggggg

SEQ ID NO: 2352 - DNA, 25 bp, Artificial sequence
  Affy probe set ID: 218368_s_at
acttggggggcagacttgacactag

SEQ ID NO: 2353 - DNA, 25 bp, Artificial sequence
  Affy probe set ID: 218368_s_at
tcagatgtcctgaaattccaccacg

SEQ ID NO: 2354 - DNA, 25 bp, Artificial sequence
  Affy probe set ID: 218368_s_at
aacactaggggctggcccactagga

SEQ ID NO: 2355 - DNA, 25 bp, Artificial sequence
  Affy probe set ID: 218368_s_at
agggctggccctaagatacagaccc

SEQ ID NO: 2356 - DNA, 536 bp, Artificial sequence
  Target_Sequence, Fragment of GenBank Accession No. NM_004460
acagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcagaactcagcacagattgctaaagctctggttaatgcacaagtggatttccaggcaatgtggtactctgaccagaaccacggcttatccggcctgtccacgaaccacttatacacccacatgacccacttcctaaagcagtg

SEQ ID NO: 2357 - DNA, 25 bp, Artificial sequence
  Affy probe set ID: 209955_s_at
acagctttccaaggtgacaaactcc

SEQ ID NO: 2358 - DNA, 25 bp, Artificial sequence
  Affy probe set ID: 209955_s_at
aaactcctctatgcagtgtatcgaa

SEQ ID NO: 2359 - DNA, 25 bp, Artificial sequence
  Affy probe set ID: 209955_s_at
atagccatatggggctggtcctatg

SEQ ID NO: 2360 - DNA, 25 bp, Artificial sequence
  Affy probe set ID: 209955_s_at
tggaggatacgtttcatcactggcc

SEQ ID NO: 2361 - DNA, 25 bp, Artificial sequence
  Affy probe set ID: 209955_s_at
ccttgcatctggaactggtcttttc

SEQ ID NO: 2362 - DNA, 25 bp, Artificial sequence
  Affy probe set ID: 209955_s_at
tggtatagcagtggctccagtctcc

SEQ ID NO: 2363 - DNA, 25 bp, Artificial sequence
  Affy probe set ID: 209955_s_at
gaatattacgcgtctgtctacacag

SEQ ID NO: 2364 - DNA, 25 bp, Artificial sequence
  Affy probe set ID: 209955_s_at
gagagattcatgggtctcccaacaa

SEQ ID NO: 2365 - DNA, 25 bp, Artificial sequence
  Affy probe set ID: 209955_s_at
aatgtagactatcttctcatccacg

SEQ ID NO: 2366 - DNA, 25 bp, Artificial sequence
  Affy probe set ID: 209955_s_at
tgaccagaaccacggcttatccggc

SEQ ID NO: 2367 - DNA, 25 bp, Artificial sequence
  Affy probe set ID: 209955_s_at
acatgacccacttcctaaagcagtg

SEQ ID NO: 2368 - DNA, 541 bp, Artificial sequence
  Target_Sequence, Fragment of GenBank Accession No. NM_000064
ggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtc

SEQ ID NO: 2369 - DNA, 25 bp, Artificial sequence
  Affy probe set ID: 217767_at
ggtctacgcctattacaacctggag

SEQ ID NO: 2370 - DNA, 25 bp, Artificial sequence
  Affy probe set ID: 217767_at
aagctctgccgtgatgaactgtgcc

SEQ ID NO: 2371 - DNA, 25 bp, Artificial sequence
  Affy probe set ID: 217767_at
gaacggctggacaaggcctgtgagc

SEQ ID NO: 2372 - DNA, 25 bp, Artificial sequence
  Affy probe set ID: 217767_at
ggttcagctgtccaatgactttgac

SEQ ID NO: 2373 - DNA, 25 bp, Artificial sequence
  Affy probe set ID: 217767_at
gcagaccatcaagtcaggctcggat

SEQ ID NO: 2374 - DNA, 25 bp, Artificial sequence
  Affy probe set ID: 217767_at
tcatcagccccatcaagtgcagaga

SEQ ID NO: 2375 - DNA, 25 bp, Artificial sequence
  Affy probe set ID: 217767_at
aacactacctcatgtggggtctctc

SEQ ID NO: 2376 - DNA, 25 bp, Artificial sequence
  Affy probe set ID: 217767_at
gtctctcctccgatttctggggaga

SEQ ID NO: 2377 - DNA, 25 bp, Artificial sequence
  Affy probe set ID: 217767_at
gtggagcactggcctgaggaggacg

SEQ ID NO: 2378 - DNA, 25 bp, Artificial sequence
  Affy probe set ID: 217767_at
agaaacaatgccaggacctcggcgc

SEQ ID NO: 2379 - DNA, 25 bp, Artificial sequence
  Affy probe set ID: 217767_at
cgccttcaccgagagcatggttgtc

SEQ ID NO: 2380 - DNA, 515 bp, Artificial sequence
  Target_Sequence, Fragment of GenBank Accession No. NM_016206
  misc_feature (241)..(241): n is a, c, g, or t
gggaaaggttttcatgtgaattctttgtatcactttgaagtacatatatttaaagggaagatggatacaatttgtttttattatataaatctaggtaaggtgaaatgcttttgtcaacaaaaatacagtgtagtgaattttatatttgtcacttgattaggtaaactgaaaactaacaatagaaatattattttactgcattgaaataccatgaactttcagacttgttagttctacaagnagttgtgctaccttaattttgtgtttccagaaataaaaattaaccttagttatgctgtcatttttaactaataaaaaaagtataattcataaaacttttggctttataagataattataaaattatatatttttttctgtttttgtggggttgggaaaacattttcttatttctattcactcttcaaatgcaggtctcataatatgtgtcaatgatataagatgatggaagactttgtaataaaaacatatgtcattatcttcaatttgttcaa

SEQ ID NO: 2381 - DNA, 25 bp, Artificial sequence
  Affy probe set ID: 227399_at
gggaaaggttttcatgtgaattctt

SEQ ID NO: 2382 - DNA, 25 bp, Artificial sequence
  Affy probe set ID: 227399_at
atgtgaattctttgtatcactttga

SEQ ID NO: 2383 - DNA, 25 bp, Artificial sequence
  Affy probe set ID: 227399_at
tatatttgtcacttgattaggtaaa

SEQ ID NO: 2384 - DNA, 25 bp, Artificial sequence
  Affy probe set ID: 227399_at
actgcattgaaataccatgaacttt

SEQ ID NO: 2385 - DNA, 25 bp, Artificial sequence
  Affy probe set ID: 227399_at
aactttcagacttgttagttctaca

SEQ ID NO: 2386 - DNA, 25 bp, Artificial sequence
  Affy probe set ID: 227399_at
agttgtgctaccttaattttgtgtt

SEQ ID NO: 2387 - DNA, 25 bp, Artificial sequence
  Affy probe set ID: 227399_at
attaaccttagttatgctgtcattt

SEQ ID NO: 2388 - DNA, 25 bp, Artificial sequence
  Affy probe set ID: 227399_at
tttcttatttctattcactcttcaa

SEQ ID NO: 2389 - DNA, 25 bp, Artificial sequence
  Affy probe set ID: 227399_at
tcactcttcaaatgcaggtctcata

SEQ ID NO: 2390 - DNA, 25 bp, Artificial sequence
  Affy probe set ID: 227399_at
gcaggtctcataatatgtgtcaatg

SEQ ID NO: 2391 - DNA, 25 bp, Artificial sequence
  Affy probe set ID: 227399_at
atgtcattatcttcaatttgttcaa

SEQ ID NO: 2392 - DNA, 431 bp, Artificial sequence
  Target_Sequence, Fragment of GenBank Accession No. NM_004339
agttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtc

SEQ ID NO: 2393 - DNA, 25 bp, Artificial sequence
  Affy probe set ID: 200677_at
agttcacaggcagatcactgatcca

SEQ ID NO: 2394 - DNA, 25 bp, Artificial sequence
  Affy probe set ID: 200677_at
aagcctttttgactgtgtacatctg

SEQ ID NO: 2395 - DNA, 25 bp, Artificial sequence
  Affy probe set ID: 200677_at
gaacctgtacccagttcttcaggct

SEQ ID NO: 2396 - DNA, 25 bp, Artificial sequence
  Affy probe set ID: 200677_at
gttcttcaggctgatttccctgacc

SEQ ID NO: 2397 - DNA, 25 bp, Artificial sequence
  Affy probe set ID: 200677_at
ttccctgacctcttgggcatttgta

SEQ ID NO: 2398 - DNA, 25 bp, Artificial sequence
  Affy probe set ID: 200677_at
tgcgtgcaaaatccgcttcctgagc

SEQ ID NO: 2399 - DNA, 25 bp, Artificial sequence
  Affy probe set ID: 200677_at
gagcgtagggtgctgagctggcgct

SEQ ID NO: 2400 - DNA, 25 bp, Artificial sequence
  Affy probe set ID: 200677_at
tggcgctagggctcggttgtgaaat

SEQ ID NO: 2401 - DNA, 25 bp, Artificial sequence
  Affy probe set ID: 200677_at
tgaaatacagcgtagtcagcccttg

SEQ ID NO: 2402 - DNA, 25 bp, Artificial sequence
  Affy probe set ID: 200677_at
gcgctcagtgtagaaacccacgtct

SEQ ID NO: 2403 - DNA, 25 bp, Artificial sequence
  Affy probe set ID: 200677_at
cacgtctgtaaggtcggtcttcgtc

SEQ ID NO: 2404 - DNA, 389 bp, Artificial sequence
  Target_Sequence, Fragment of GenBank Accession No. NM_003255
  misc_feature (74)..(74): n is a, c, g, or t
  misc_feature (181)..(181): n is a, c, g, or t
ttgtttttgacatcagctgtaatcattcctgtgctgtgttttttattacccttggtaggtattagacttgcacnttttttaaaaaaaggtttctgcatcgtggaagcatttgacccagagtggaacgcgtggcctatgcaggtggattccttcaggtctttcctttggttctttgagcatnctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaat

SEQ ID NO: 2405 - DNA, 25 bp, Artificial sequence
  Affy probe set ID: 224560_at
ttgtttttgacatcagctgtaatca

SEQ ID NO: 2406 - DNA, 25 bp, Artificial sequence
  Affy probe set ID: 224560_at
catcagctgtaatcattcctgtgct

SEQ ID NO: 2407 - DNA, 25 bp, Artificial sequence
  Affy probe set ID: 224560_at
cccttggtaggtattagacttgcac

SEQ ID NO: 2408 - DNA, 25 bp, Artificial sequence
  Affy probe set ID: 224560_at
aacgcgtggcctatgcaggtggatt

SEQ ID NO: 2409 - DNA, 25 bp, Artificial sequence
  Affy probe set ID: 224560_at
ggcctatgcaggtggattccttcag

SEQ ID NO: 2410 - DNA, 25 bp, Artificial sequence
  Affy probe set ID: 224560_at
tgcaggtggattccttcaggtcttt

SEQ ID NO: 2411 - DNA, 25 bp, Artificial sequence
  Affy probe set ID: 224560_at
acaggttaagaagagccgggtggca

SEQ ID NO: 2412 - DNA, 25 bp, Artificial sequence
  Affy probe set ID: 224560_at
gttaagaagagccgggtggcagctg

SEQ ID NO: 2413 - DNA, 25 bp, Artificial sequence
  Affy probe set ID: 224560_at
gtggcagctgacagaggaagccgct

SEQ ID NO: 2414 - DNA, 25 bp, Artificial sequence
  Affy probe set ID: 224560_at
gaggaagccgctcaaataccttcac

SEQ ID NO: 2415 - DNA, 25 bp, Artificial sequence
  Affy probe set ID: 224560_at
gaagccgctcaaataccttcacaat

SEQ ID NO: 2416 - DNA, 418 bp, Artificial sequence
  Target_Sequence, Fragment of GenBank Accession No. NM_002998
tatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtg

SEQ ID NO: 2417 - DNA, 25 bp, Artificial sequence
  Affy probe set ID: 212158_at
tatgtaaactttaacttccactttg

SEQ ID NO: 2418 - DNA, 25 bp, Artificial sequence
  Affy probe set ID: 212158_at
ttttcattacctgtagctttgggca

SEQ ID NO: 2419 - DNA, 25 bp, Artificial sequence
  Affy probe set ID: 212158_at
aaaaccgtttagtcatatctatcta

SEQ ID NO: 2420 - DNA, 25 bp, Artificial sequence
  Affy probe set ID: 212158_at
atctaatcagatcttcttttgggag

SEQ ID NO: 2421 - DNA, 25 bp, Artificial sequence
  Affy probe set ID: 212158_at
tgatgtaagttactgacaagcctca

SEQ ID NO: 2422 - DNA, 25 bp, Artificial sequence
  Affy probe set ID: 212158_at
acaagcctcagcaaacccaaagatg

SEQ ID NO: 2423 - DNA, 25 bp, Artificial sequence
  Affy probe set ID: 212158_at
agaagttgctgcagattcctttggc

SEQ ID NO: 2424 - DNA, 25 bp, Artificial sequence
  Affy probe set ID: 212158_at
attcctttggccactgtatttgtta

SEQ ID NO: 2425 - DNA, 25 bp, Artificial sequence
  Affy probe set ID: 212158_at
gcctttgaagtgcctctgattctat

SEQ ID NO: 2426 - DNA, 25 bp, Artificial sequence
  Affy probe set ID: 212158_at
gtgcctctgattctatgtaacttgt

SEQ ID NO: 2427 - DNA, 25 bp, Artificial sequence
  Affy probe set ID: 212158_at
ctatgtaacttgttgcagactggtg

SEQ ID NO: 2428 - DNA, 458 bp, Artificial sequence
  Target_Sequence, Fragment of GenBank Accession No. NM_012223
atgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttcttt

SEQ ID NO: 2429 - DNA, 25 bp, Artificial sequence
  Affy probe set ID: 212364_at
atgaccaggttaaatccctctacat

SEQ ID NO: 2430 - DNA, 25 bp, Artificial sequence
  Affy probe set ID: 212364_at
taaatccctctacatgtggtttctg

SEQ ID NO: 2431 - DNA, 25 bp, Artificial sequence
  Affy probe set ID: 212364_at
ctgacatttgaacaggacttttaat

SEQ ID NO: 2432 - DNA, 25 bp, Artificial sequence
  Affy probe set ID: 212364_at
gaagcagtccagtaagattatatgt

SEQ ID NO: 2433 - DNA, 25 bp, Artificial sequence
  Affy probe set ID: 212364_at
atgtttctgtttctggtaaatacca

SEQ ID NO: 2434 - DNA, 25 bp, Artificial sequence
  Affy probe set ID: 212364_at
gtaaataccatatatgatcctcgaa

SEQ ID NO: 2435 - DNA, 25 bp, Artificial sequence
  Affy probe set ID: 212364_at
gaatattgttttcacccaaatttga

SEQ ID NO: 2436 - DNA, 25 bp, Artificial sequence
  Affy probe set ID: 212364_at
aaagccattcagatagcagtaaaac

SEQ ID NO: 2437 - DNA, 25 bp, Artificial sequence
  Affy probe set ID: 212364_at
aggtgattggtacagggtgcctatt

SEQ ID NO: 2438 - DNA, 25 bp, Artificial sequence
  Affy probe set ID: 212364_at
gggtgcctattttagtcatggatca

SEQ ID NO: 2439 - DNA, 25 bp, Artificial sequence
  Affy probe set ID: 212364_at
gtaacttgcagggctttctttcttt

SEQ ID NO: 2440 - DNA, 377 bp, Artificial sequence
  Target_Sequence, Fragment of GenBank Accession No. NM_020650
  misc_feature (36)..(36): n is a, c, g, or t
  misc_feature (47)..(48): n is a, c, g, or t
  misc_feature (55)..(55): n is a, c, g, or t
  misc_feature (108)..(108): n is a, c, g, or t
  misc_feature (144)..(144): n is a, c, g, or t
  misc_feature (234)..(234): n is a, c, g, or t
  misc_feature (274)..(274): n is a, c, g, or t
  misc_feature (295)..(295): n is a, c, g, or t
aaccacctgctgcacgagagcgacacggacaaggangggcggctgannaaagcgnaaatcctgggtaattggaacatgtttgtgggcagtcaggccaccaactatggngaggacctgacccggcaccacgatgagctgtgagcnccgcgcacctgccacagcctcagaggcccgcacaatgaccggaggaggggccgctgtggtctggccccctccctgtccaggccccgcagnaggcagatgcagtcccaggcatcctcctgcccctgggctntcagggaccccctgggtcggncttctgtccctgtcacacccccaaccccagggaggggctgtcatagtcccagaggataagcaatacctatttctgactgagt

SEQ ID NO: 2441 - DNA, 25 bp, Artificial sequence
  Affy probe set ID: 61734_at
aaccacctgctgcacgagagcgaca

SEQ ID NO: 2442 - DNA, 25 bp, Artificial sequence
  Affy probe set ID: 61734_at
tgcacgagagcgacacggacaagga

SEQ ID NO: 2443 - DNA, 25 bp, Artificial sequence
  Affy probe set ID: 61734_at
atgtttgtgggcagtcaggccacca

SEQ ID NO: 2444 - DNA, 25 bp, Artificial sequence
  Affy probe set ID: 61734_at
ttgtgggcagtcaggccaccaacta

SEQ ID NO: 2445 - DNA, 25 bp, Artificial sequence
  Affy probe set ID: 61734_at
ctgacccggcaccacgatgagctgt

SEQ ID NO: 2446 - DNA, 25 bp, Artificial sequence
  Affy probe set ID: 61734_at
cccggcaccacgatgagctgtgagc

SEQ ID NO: 2447 - DNA, 25 bp, Artificial sequence
  Affy probe set ID: 61734_at
tcagaggcccgcacaatgaccggag

SEQ ID NO: 2448 - DNA, 25 bp, Artificial sequence
  Affy probe set ID: 61734_at
agaggcccgcacaatgaccggagga

SEQ ID NO: 2449 - DNA, 25 bp, Artificial sequence
  Affy probe set ID: 61734_at
aggcagatgcagtcccaggcatcct

SEQ ID NO: 2450 - DNA, 25 bp, Artificial sequence
  Affy probe set ID: 61734_at
agatgcagtcccaggcatcctcctg

SEQ ID NO: 2451 - DNA, 25 bp, Artificial sequence
  Affy probe set ID: 61734_at
aggggctgtcatagtcccagaggat

SEQ ID NO: 2452 - DNA, 398 bp, Artificial sequence
  Target_Sequence, Fragment of GenBank Accession No. AL573464
tgtcattattcccattcctggtgtttttactggttcatatacaatggtattctattagataagaagctgctatgtgatctcagcactcactccttggttgtcaagaaatggtggataactcacaggattaaaaatgaatgaatataaaattttctgaaatagatatttaaaaaatcattttagcttgaagccaatatgtctggatcataggttttgagttcataatccagtaataacagctttcagctttctatgagtatatacaattctatacaatgataaatactctgcatataatttataaaaataacttctgttttacctagttaacaataaaacctatgtgtggagccaaatgttatgcagacaaaggtctgctcatcccataccagtgtata

SEQ ID NO: 2453 - DNA, 25 bp, Artificial sequence
  Affy probe set ID: 229554_at
tgtcattattcccattcctggtgtt

SEQ ID NO: 2454 - DNA, 25 bp, Artificial sequence
  Affy probe set ID: 229554_at
attcctggtgtttttactggttcat

SEQ ID NO: 2455 - DNA, 25 bp, Artificial sequence
  Affy probe set ID: 229554_at
gcactcactccttggttgtcaagaa

SEQ ID NO: 2456 - DNA, 25 bp, Artificial sequence
  Affy probe set ID: 229554_at
aaatggtggataactcacaggatta

SEQ ID NO: 2457 - DNA, 25 bp, Artificial sequence
  Affy probe set ID: 229554_at
gaagccaatatgtctggatcatagg

SEQ ID NO: 2458 - DNA, 25 bp, Artificial sequence
  Affy probe set ID: 229554_at
taggttttgagttcataatccagta

SEQ ID NO: 2459 - DNA, 25 bp, Artificial sequence
  Affy probe set ID: 229554_at
aatccagtaataacagctttcagct

SEQ ID NO: 2460 - DNA, 25 bp, Artificial sequence
  Affy probe set ID: 229554_at
gctttcagctttctatgagtatata

SEQ ID NO: 2461 - DNA, 25 bp, Artificial sequence
  Affy probe set ID: 229554_at
ataaaacctatgtgtggagccaaat

SEQ ID NO: 2462 - DNA, 25 bp, Artificial sequence
  Affy probe set ID: 229554_at
gtgtggagccaaatgttatgcagac

SEQ ID NO: 2463 - DNA, 25 bp, Artificial sequence
  Affy probe set ID: 229554_at
tctgctcatcccataccagtgtata

SEQ ID NO: 2464 - DNA, 516 bp, Artificial sequence
  Target_Sequence, Fragment of GenBank Accession No. AK001903
ttaccctctatttaaatgctttgaaaaacagtgcattgacaatgggttgatatttttctttaaaagaaaaatataattatgaaagccaagataatctgaagcctgttttattttaaaactttttatgttctgtggttgatgttgtttgtttgtttgtttctattttgttggttttttactttgttttttgttttgttttgttttgttttgcatactacatgcagttctttaaccaatgtctgtttggctaatgtaattaaagttgttaatttatatgagtgcatttcaactatgtcaatggtttcttaatatttattgtgtagaagtactggtaatttttttatttacaatatgtttaaagagataacagtttgatatgttttcatgtgtttatagcagaagttatttatttctatggcattccagcggatattttggtgtttgcgaggcatgcagtcaatattttgtacagttagtggacagtattcagcaacgcctgatagcttctttggcctt

SEQ ID NO: 2465 - DNA, 25 bp, Artificial sequence
  Affy probe set ID: 227140_at
ttaccctctatttaaatgctttgaa

SEQ ID NO: 2466 - DNA, 25 bp, Artificial sequence
  Affy probe set ID: 227140_at
gccaagataatctgaagcctgtttt

SEQ ID NO: 2467 - DNA, 25 bp, Artificial sequence
  Affy probe set ID: 227140_at
tatgttctgtggttgatgttgtttg

SEQ ID NO: 2468 - DNA, 25 bp, Artificial sequence
  Affy probe set ID: 227140_at
gcagttctttaaccaatgtctgttt

SEQ ID NO: 2469 - DNA, 25 bp, Artificial sequence
  Affy probe set ID: 227140_at
atgagtgcatttcaactatgtcaat

SEQ ID NO: 2470 - DNA, 25 bp, Artificial sequence
  Affy probe set ID: 227140_at
aagttatttatttctatggcattcc

SEQ ID NO: 2471 - DNA, 25 bp, Artificial sequence
  Affy probe set ID: 227140_at
atggcattccagcggatattttggt

SEQ ID NO: 2472 - DNA, 25 bp, Artificial sequence
  Affy probe set ID: 227140_at
gatattttggtgtttgcgaggcatg

SEQ ID NO: 2473 - DNA, 25 bp, Artificial sequence
  Affy probe set ID: 227140_at
gcgaggcatgcagtcaatattttgt

SEQ ID NO: 2474 - DNA, 25 bp, Artificial sequence
  Affy probe set ID: 227140_at
tagtggacagtattcagcaacgcct

SEQ ID NO: 2475 - DNA, 25 bp, Artificial sequence
  Affy probe set ID: 227140_at
aacgcctgatagcttctttggcctt

SEQ ID NO: 2476 - DNA, 478 bp, Artificial sequence
  Target_Sequence, Fragment of GenBank Accession No. NM_005928
ctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatat

SEQ ID NO: 2477 - DNA, 25 bp, Artificial sequence
  Affy probe set ID: 210605_s_at
ctcactgtcctgttttcttaggcac

SEQ ID NO: 2478 - DNA, 25 bp, Artificial sequence
  Affy probe set ID: 210605_s_at
tgtcctgttttcttaggcactgagg

SEQ ID NO: 2479 - DNA, 25 bp, Artificial sequence
  Affy probe set ID: 210605_s_at
ctgagggatctgagtaggtctggga

SEQ ID NO: 2480 - DNA, 25 bp, Artificial sequence
  Affy probe set ID: 210605_s_at
gaaagggcaaagtagggcgtgtggt

SEQ ID NO: 2481 - DNA, 25 bp, Artificial sequence
  Affy probe set ID: 210605_s_at
caaagtagggcgtgtggtttccctg

SEQ ID NO: 2482 - DNA, 25 bp, Artificial sequence
  Affy probe set ID: 210605_s_at
cattcccatggtggcctcaagaaag

SEQ ID NO: 2483 - DNA, 25 bp, Artificial sequence
  Affy probe set ID: 210605_s_at
gtggcctcaagaaaggcccggaagc

SEQ ID NO: 2484 - DNA, 25 bp, Artificial sequence
  Affy probe set ID: 210605_s_at
gctggagataacagcctcttgcccg

SEQ ID NO: 2485 - DNA, 25 bp, Artificial sequence
  Affy probe set ID: 210605_s_at
gaagcccagcgacacagaagggggt

SEQ ID NO: 2486 - DNA, 25 bp, Artificial sequence
  Affy probe set ID: 210605_s_at
gtggggcgggtctatggggagaaag

SEQ ID NO: 2487 - DNA, 25 bp, Artificial sequence
  Affy probe set ID: 210605_s_at
gacacaggcagcttccaaaatatat

SEQ ID NO: 2488 - DNA, 396 bp, Artificial sequence
  Target_Sequence, Fragment of GenBank Accession No. NM_000943
gaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggcatgaccgtccactcaccaactgctcgatcatcaacagtggcaagatagacgtgaaaacgccttttgtggttgagatcgctgattggtgacacaact

SEQ ID NO: 2489 - DNA, 25 bp, Artificial sequence
  Affy probe set ID: 204518_s_at
gaagcaagtttcatcgtgtcatcaa

SEQ ID NO: 2490 - DNA, 25 bp, Artificial sequence
  Affy probe set ID: 204518_s_at
gtgacatcaccactggagatggcac

SEQ ID NO: 2491 - DNA, 25 bp, Artificial sequence
  Affy probe set ID: 204518_s_at
actgggggtgtgagcatctatggtg

SEQ ID NO: 2492 - DNA, 25 bp, Artificial sequence
  Affy probe set ID: 204518_s_at
ggcattgggtgggtcagcatggcca

SEQ ID NO: 2493 - DNA, 25 bp, Artificial sequence
  Affy probe set ID: 204518_s_at
tctttatcaccttgaccaagcccac

SEQ ID NO: 2494 - DNA, 25 bp, Artificial sequence
  Affy probe set ID: 204518_s_at
gcccacctggttggacggcaaacat

SEQ ID NO: 2495 - DNA, 25 bp, Artificial sequence
  Affy probe set ID: 204518_s_at
tgcactccatagagctccaagcaac

SEQ ID NO: 2496 - DNA, 25 bp, Artificial sequence
  Affy probe set ID: 204518_s_at
aagcaactgatgggcatgaccgtcc

SEQ ID NO: 2497 - DNA, 25 bp, Artificial sequence
  Affy probe set ID: 204518_s_at
tcaccaactgctcgatcatcaacag

SEQ ID NO: 2498 - DNA, 25 bp, Artificial sequence
  Affy probe set ID: 204518_s_at
acgccttttgtggttgagatcgctg

SEQ ID NO: 2499 - DNA, 25 bp, Artificial sequence
  Affy probe set ID: 204518_s_at
gagatcgctgattggtgacacaact

SEQ ID NO: 2500 - DNA, 515 bp, Artificial sequence
  Target_Sequence, Fragment of GenBank Accession No. NM_001008397
  misc_feature (135)..(135): n is a, c, g, or t
  misc_feature (179)..(179): n is a, c, g, or t
ggcctgacatagcagctctggttagacaagtgatcataaaaaagaaagaggatctatgagaatgccattgcgtttctaatagaacagagaaatgtctccatgagggtttggtctcattttaaacatttttttttnggagacagtgtctcactctgtcacccaggctggagtgcagtagngcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttc

SEQ ID NO: 2501 - DNA, 25 bp, Artificial sequence
  Affy probe set ID: 227628_at
ggcctgacatagcagctctggttag

SEQ ID NO: 2502 - DNA, 25 bp, Artificial sequence
  Affy probe set ID: 227628_at
atgagaatgccattgcgtttctaat

SEQ ID NO: 2503 - DNA, 25 bp, Artificial sequence
  Affy probe set ID: 227628_at
gagggtttggtctcattttaaacat

SEQ ID NO: 2504 - DNA, 25 bp, Artificial sequence
  Affy probe set ID: 227628_at
ctctgcctttttaaacatgctatta

SEQ ID NO: 2505 - DNA, 25 bp, Artificial sequence
  Affy probe set ID: 227628_at
atatattaactacttcctctgacca

SEQ ID NO: 2506 - DNA, 25 bp, Artificial sequence
  Affy probe set ID: 227628_at
actacttcctctgaccatactaaag

SEQ ID NO: 2507 - DNA, 25 bp, Artificial sequence
  Affy probe set ID: 227628_at
gtgaccaatgtgcctcaatatctta

SEQ ID NO: 2508 - DNA, 25 bp, Artificial sequence
  Affy probe set ID: 227628_at
gacattttctaggactgtacttgat

SEQ ID NO: 2509 - DNA, 25 bp, Artificial sequence
  Affy probe set ID: 227628_at
gaaaatgccaacacactagaccact

SEQ ID NO: 2510 - DNA, 25 bp, Artificial sequence
  Affy probe set ID: 227628_at
actagaccactctttggattcaaga

SEQ ID NO: 2511 - DNA, 25 bp, Artificial sequence
  Affy probe set ID: 227628_at
gagcactgtgtatgactgaaatttc

SEQ ID NO: 2512 - DNA, 483 bp, Artificial sequence
  Target_Sequence, Fragment of GenBank Accession No. AK025431
atttttccatcttattcaagtcagagcacttttttttaaatagcaatacaacaggcaagagaatactcaaaaatatttaaaactgtattgataccaagagtatgttttaaatattttctaataaatacttgagcggtttttgtctggcaggcttccaaatttgccaaaattaagcgttcagtattttcaacacatacgctttttactggtttatactgaactatctgatgagaattcctgtgttcccaaagcaactgatgtttacaggtcttgtgtttctcctcctcctttctaaggatgagggaatccacaacagactttctctagaaaacactaatgatggacaactttttggtgtcatcaatgagttggctactaccttgatgtaaaaatttgtaaggaaaattttcaccatttcgagtgtcaagtgtatttttaactgtctggtttgtacttttatgacttttgtactaccaaagcgga

SEQ ID NO: 2513 - DNA, 25 bp, Artificial sequence
  Affy probe set ID: 226430_at
atttttccatcttattcaagtcaga

SEQ ID NO: 2514 - DNA, 25 bp, Artificial sequence
  Affy probe set ID: 226430_at
cttgagcggtttttgtctggcaggc

SEQ ID NO: 2515 - DNA, 25 bp, Artificial sequence
  Affy probe set ID: 226430_at
aagcgttcagtattttcaacacata

SEQ ID NO: 2516 - DNA, 25 bp, Artificial sequence
  Affy probe set ID: 226430_at
gaattcctgtgttcccaaagcaact

SEQ ID NO: 2517 - DNA, 25 bp, Artificial sequence
  Affy probe set ID: 226430_at
atgtttacaggtcttgtgtttctcc

SEQ ID NO: 2518 - DNA, 25 bp, Artificial sequence
  Affy probe set ID: 226430_at
cctcctcctttctaaggatgaggga

SEQ ID NO: 2519 - DNA, 25 bp, Artificial sequence
  Affy probe set ID: 226430_at
gagggaatccacaacagactttctc

SEQ ID NO: 2520 - DNA, 25 bp, Artificial sequence
  Affy probe set ID: 226430_at
atgagttggctactaccttgatgta

SEQ ID NO: 2521 - DNA, 25 bp, Artificial sequence
  Affy probe set ID: 226430_at
aattttcaccatttcgagtgtcaag

SEQ ID NO: 2522 - DNA, 25 bp, Artificial sequence
  Affy probe set ID: 226430_at
aactgtctggtttgtacttttatga

SEQ ID NO: 2523 - DNA, 25 bp, Artificial sequence
  Affy probe set ID: 226430_at
atgacttttgtactaccaaagcgga

SEQ ID NO: 2524 - DNA, 511 bp, Artificial sequence
  Target_Sequence, Fragment of GenBank Accession No. NM_000297
  misc_feature (424)..(424): n is a, c, g, or t
  misc_feature (441)..(441): n is a, c, g, or t
  misc_feature (450)..(450): n is a, c, g, or t
gaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcactagaaagtctctttatgatactttttattgtactgtttttcatttcacttgcaaaattttgcagaattcctcctttctacccataaattacatataatttttcttctttagtcatggagaacncccccccatcatctcanccctattanctttcccatgtgtactggtattattaaaaagacatttacatacgcaagtttttcactgaca

SEQ ID NO: 2525 - DNA, 25 bp, Artificial sequence
  Affy probe set ID: 203688_at
gaatgtcagtccaatctccaatgag

SEQ ID NO: 2526 - DNA, 25 bp, Artificial sequence
  Affy probe set ID: 203688_at
acatgagcaaatagacctttccagg

SEQ ID NO: 2527 - DNA, 25 bp, Artificial sequence
  Affy probe set ID: 203688_at
gtttctgtaagtttttcctcatggc

SEQ ID NO: 2528 - DNA, 25 bp, Artificial sequence
  Affy probe set ID: 203688_at
ttactttctcttgaatatgctacac

SEQ ID NO: 2529 - DNA, 25 bp, Artificial sequence
  Affy probe set ID: 203688_at
acatactaaagtttgcattccaggg

SEQ ID NO: 2530 - DNA, 25 bp, Artificial sequence
  Affy probe set ID: 203688_at
gcattccagggatattgactgtaca

SEQ ID NO: 2531 - DNA, 25 bp, Artificial sequence
  Affy probe set ID: 203688_at
tatgtggtatccatgtgtatcgacc

SEQ ID NO: 2532 - DNA, 25 bp, Artificial sequence
  Affy probe set ID: 203688_at
gtgtatcgaccatgtgccatatatc

SEQ ID NO: 2533 - DNA, 25 bp, Artificial sequence
  Affy probe set ID: 203688_at
tatggtcactagaaagtctctttat

SEQ ID NO: 2534 - DNA, 25 bp, Artificial sequence
  Affy probe set ID: 203688_at
cctcctttctacccataaattacat

SEQ ID NO: 2535 - DNA, 25 bp, Artificial sequence
  Affy probe set ID: 203688_at
tacatacgcaagtttttcactgaca

SEQ ID NO: 2536 - DNA, 335 bp, Artificial sequence
  Target_Sequence, Fragment of GenBank Accession No. NM_002975
cggtggcacgctcgagaactgcgtggcgcaggcctctgacgacggctcctggtgggaccacgactgccagcggcgtctctactacgtctgcgagttccccttctagcggggccggtaccccgcctccttgcccatcccaccacccggcctttccctgcgccgtgcccaccctcctccggaatcgcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatcct

SEQ ID NO: 2537 - DNA, 25 bp, Artificial sequence
  Affy probe set ID: 211709_s_at
cggtggcacgctcgagaactgcgtg

SEQ ID NO: 2538 - DNA, 25 bp, Artificial sequence
  Affy probe set ID: 211709_s_at
tggcacgctcgagaactgcgtggcg

SEQ ID NO: 2539 - DNA, 25 bp, Artificial sequence
  Affy probe set ID: 211709_s_at
cccagtctgggcgcttctgggaggg

SEQ ID NO: 2540 - DNA, 25 bp, Artificial sequence
  Affy probe set ID: 211709_s_at
tccttgttagtgtctttccttgaag

SEQ ID NO: 2541 - DNA, 25 bp, Artificial sequence
  Affy probe set ID: 211709_s_at
cttgttagtgtctttccttgaaggg

SEQ ID NO: 2542 - DNA, 25 bp, Artificial sequence
  Affy probe set ID: 211709_s_at
tgttagtgtctttccttgaaggggc

SEQ ID NO: 2543 - DNA, 25 bp, Artificial sequence
  Affy probe set ID: 211709_s_at
ttagtgtctttccttgaaggggcgg

SEQ ID NO: 2544 - DNA, 25 bp, Artificial sequence
  Affy probe set ID: 211709_s_at
cgggcaccaggctaggtccggtgcc

SEQ ID NO: 2545 - DNA, 25 bp, Artificial sequence
  Affy probe set ID: 211709_s_at
gcaccaggctaggtccggtgccaat

SEQ ID NO: 2546 - DNA, 25 bp, Artificial sequence
  Affy probe set ID: 211709_s_at
ccaggctaggtccggtgccaataaa

SEQ ID NO: 2547 - DNA, 25 bp, Artificial sequence
  Affy probe set ID: 211709_s_at
gctaggtccggtgccaataaatcct

SEQ ID NO: 2548 - DNA, 484 bp, Artificial sequence
  Target_Sequence, Fragment of GenBank Accession No. NM_001920
ttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaacta

SEQ ID NO: 2549 - DNA, 25 bp, Artificial sequence
  Affy probe set ID: 211813_x_at
ttgcacaagtttcctgggctggacc

SEQ ID NO: 2550 - DNA, 25 bp, Artificial sequence
  Affy probe set ID: 211813_x_at
aggcccagaagttcctgatgaccgc

SEQ ID NO: 2551 - DNA, 25 bp, Artificial sequence
  Affy probe set ID: 211813_x_at
gtcaatgccatcttcgagtggtcca

SEQ ID NO: 2552 - DNA, 25 bp, Artificial sequence
  Affy probe set ID: 211813_x_at
caaagtgccaaaggatcttccccct

SEQ ID NO: 2553 - DNA, 25 bp, Artificial sequence
  Affy probe set ID: 211813_x_at
ctgacacaactctgctagacctgca

SEQ ID NO: 2554 - DNA, 25 bp, Artificial sequence
  Affy probe set ID: 211813_x_at
tgaagaaccttcacgttgtctacct

SEQ ID NO: 2555 - DNA, 25 bp, Artificial sequence
  Affy probe set ID: 211813_x_at
gttggatcaagtgacttctgcccac

SEQ ID NO: 2556 - DNA, 25 bp, Artificial sequence
  Affy probe set ID: 211813_x_at
aaggcttcttattcgggtgtgagtc

SEQ ID NO: 2557 - DNA, 25 bp, Artificial sequence
  Affy probe set ID: 211813_x_at
agcaacccggtccagtactgggaga

SEQ ID NO: 2558 - DNA, 25 bp, Artificial sequence
  Affy probe set ID: 211813_x_at
cagccatccaccttcagatgtgtct

SEQ ID NO: 2559 - DNA, 25 bp, Artificial sequence
  Affy probe set ID: 211813_x_at
gctctgccattcaactcggaaacta

SEQ ID NO: 2560 - DNA, 438 bp, Artificial sequence
  Target_Sequence, Fragment of GenBank Accession No. NM_001723
gacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctga

SEQ ID NO: 2561 - DNA, 25 bp, Artificial sequence
  Affy probe set ID: 215016_x_at
gacaaaaagacaaacacacccacac

SEQ ID NO: 2562 - DNA, 25 bp, Artificial sequence
  Affy probe set ID: 215016_x_at
cccacacgcagtctttgcagtatct

SEQ ID NO: 2563 - DNA, 25 bp, Artificial sequence
  Affy probe set ID: 215016_x_at
ggaagttacttcaagcacttgccag

SEQ ID NO: 2564 - DNA, 25 bp, Artificial sequence
  Affy probe set ID: 215016_x_at
gcacttgccagtactatgatattca

SEQ ID NO: 2565 - DNA, 25 bp, Artificial sequence
  Affy probe set ID: 215016_x_at
tcaagtaccttgcagcatttctctg

SEQ ID NO: 2566 - DNA, 25 bp, Artificial sequence
  Affy probe set ID: 215016_x_at
catttctctgccattgctttcaatg

SEQ ID NO: 2567 - DNA, 25 bp, Artificial sequence
  Affy probe set ID: 215016_x_at
ggcatcctggatattagacctatta

SEQ ID NO: 2568 - DNA, 25 bp, Artificial sequence
  Affy probe set ID: 215016_x_at
gaggttttcttttgcttgagtggac

SEQ ID NO: 2569 - DNA, 25 bp, Artificial sequence
  Affy probe set ID: 215016_x_at
gtagcacctgtatcattgaactcat

SEQ ID NO: 2570 - DNA, 25 bp, Artificial sequence
  Affy probe set ID: 215016_x_at
taaaacacgtcccttaactgcattg

SEQ ID NO: 2571 - DNA, 25 bp, Artificial sequence
  Affy probe set ID: 215016_x_at
gggtttattttgatttctcatctga

SEQ ID NO: 2572 - DNA, 509 bp, Artificial sequence
  Target_Sequence, Fragment of GenBank Accession No. CR749529
  misc_feature (98)..(98): n is a, c, g, or t
gtgaacctcacaaactatagaccaaaaaaataggacatcgagagaaagaatatgaagctagcataggttcacaaagaatgagtcaaatcaaacaacangcattttttatttataaagcatgacttgttcattgtcaattcatgttagcttaatcattaggcattaatgccatcactgcaatgcatatgtcagcaataaataatcaaagaccaggcttccatcattctgtttaatatcttcaagtaatgcttaagtttgcaaatgctcttttaacacattctccatatgcagcctgcccagcactgcacacaatagacctgttacttccccctcacgagcactcctaatatttcatgtgctcatccaattgacttctcccactggtgcctcatattgaatttgtagaatcacacctgctcctttttcaaaactcttctgagttttttcttaaataattcactgaccccaaagttgtcagatatttgaagactactcgcacaattttaata

SEQ ID NO: 2573 - DNA, 25 bp, Artificial sequence
  Affy probe set ID: 227554_at
gtgaacctcacaaactatagaccaa

SEQ ID NO: 2574 - DNA, 25 bp, Artificial sequence
  Affy probe set ID: 227554_at
atgccatcactgcaatgcatatgtc

SEQ ID NO: 2575 - DNA, 25 bp, Artificial sequence
  Affy probe set ID: 227554_at
caaagaccaggcttccatcattctg

SEQ ID NO: 2576 - DNA, 25 bp, Artificial sequence
  Affy probe set ID: 227554_at
tgctcttttaacacattctccatat

SEQ ID NO: 2577 - DNA, 25 bp, Artificial sequence
  Affy probe set ID: 227554_at
cacacaatagacctgttacttcccc

SEQ ID NO: 2578 - DNA, 25 bp, Artificial sequence
  Affy probe set ID: 227554_at
tcacgagcactcctaatatttcatg

SEQ ID NO: 2579 - DNA, 25 bp, Artificial sequence
  Affy probe set ID: 227554_at
ttcatgtgctcatccaattgacttc

SEQ ID NO: 2580 - DNA, 25 bp, Artificial sequence
  Affy probe set ID: 227554_at
tcccactggtgcctcatattgaatt

SEQ ID NO: 2581 - DNA, 25 bp, Artificial sequence
  Affy probe set ID: 227554_at
aatttgtagaatcacacctgctcct

SEQ ID NO: 2582 - DNA, 25 bp, Artificial sequence
  Affy probe set ID: 227554_at
ataattcactgaccccaaagttgtc

SEQ ID NO: 2583 - DNA, 25 bp, Artificial sequence
  Affy probe set ID: 227554_at
gaagactactcgcacaattttaata

SEQ ID NO: 2584 - DNA, 436 bp, Artificial sequence
  Target_Sequence, Fragment of GenBank Accession No. NM_000165
gagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcaga

SEQ ID NO: 2585 - DNA, 25 bp, Artificial sequence
  Affy probe set ID: 201667_at
gagtggactattaaatgtgcctaaa

SEQ ID NO: 2586 - DNA, 25 bp, Artificial sequence
  Affy probe set ID: 201667_at
gcagtaactggtattcttgggtttt

SEQ ID NO: 2587 - DNA, 25 bp, Artificial sequence
  Affy probe set ID: 201667_at
gcagtcttttggagtgaccagcaac

SEQ ID NO: 2588 - DNA, 25 bp, Artificial sequence
  Affy probe set ID: 201667_at
gaggattcagtagtacacatacaac

SEQ ID NO: 2589 - DNA, 25 bp, Artificial sequence
  Affy probe set ID: 201667_at
gacatctaccagtttctccaaatgc

SEQ ID NO: 2590 - DNA, 25 bp, Artificial sequence
  Affy probe set ID: 201667_at
gccttttttaaaactcatcacagaa

SEQ ID NO: 2591 - DNA, 25 bp, Artificial sequence
  Affy probe set ID: 201667_at
gagtatgacacttttcttcttgcat

SEQ ID NO: 2592 - DNA, 25 bp, Artificial sequence
  Affy probe set ID: 201667_at
tcttcttgcatgcatgtcagctaca

SEQ ID NO: 2593 - DNA, 25 bp, Artificial sequence
  Affy probe set ID: 201667_at
gacattccatgttaaactacggtca

SEQ ID NO: 2594 - DNA, 25 bp, Artificial sequence
  Affy probe set ID: 201667_at
ctacggtcatgttcagcttcattgc

SEQ ID NO: 2595 - DNA, 25 bp, Artificial sequence
  Affy probe set ID: 201667_at
tgtaatgtagacctagtccatcaga

SEQ ID NO: 2596 - DNA, 426 bp, Artificial sequence
  Target_Sequence, Fragment of GenBank Accession No. NM_012104
atatcactttggtctccatttttcccaggacaggaaatatgtccccccctaactttcttgcttcaaaaattaaaatccagcatcccaagatcattctacaagtaattttgcacagacatctcctcaccccagtgcctgtctggagctcacccaaggtcaccaaacaacttggttgtgaaccaactgccttaaccttctgggggagggggattagctagactaggagaccagaagtgaatgggaaagggtgaggacttcacaatgttggcctgtcagagcttgattagaagccaagacagtggcagcaaaggaagacttggcccaggaaaaacctgtgggttgtgctaatttctgtccagaaaatagggtggacagaagcttgtggggtgcatggaggaattgggacctggttatgttgttattctc

SEQ ID NO: 2597 - DNA, 25 bp, Artificial sequence
  Affy probe set ID: 217904_s_at
atatcactttggtctccatttttcc

SEQ ID NO: 2598 - DNA, 25 bp, Artificial sequence
  Affy probe set ID: 217904_s_at
aaatccagcatcccaagatcattct

SEQ ID NO: 2599 - DNA, 25 bp, Artificial sequence
  Affy probe set ID: 217904_s_at
taattttgcacagacatctcctcac

SEQ ID NO: 2600 - DNA, 25 bp, Artificial sequence
  Affy probe set ID: 217904_s_at
ggttgtgaaccaactgccttaacct

SEQ ID NO: 2601 - DNA, 25 bp, Artificial sequence
  Affy probe set ID: 217904_s_at
gggggagggggattagctagactag

SEQ ID NO: 2602 - DNA, 25 bp, Artificial sequence
  Affy probe set ID: 217904_s_at
gacttcacaatgttggcctgtcaga

SEQ ID NO: 2603 - DNA, 25 bp, Artificial sequence
  Affy probe set ID: 217904_s_at
gttggcctgtcagagcttgattaga

SEQ ID NO: 2604 - DNA, 25 bp, Artificial sequence
  Affy probe set ID: 217904_s_at
gcagcaaaggaagacttggcccagg

SEQ ID NO: 2605 - DNA, 25 bp, Artificial sequence
  Affy probe set ID: 217904_s_at
gggttgtgctaatttctgtccagaa

SEQ ID NO: 2606 - DNA, 25 bp, Artificial sequence
  Affy probe set ID: 217904_s_at
ggtggacagaagcttgtggggtgca

SEQ ID NO: 2607 - DNA, 25 bp, Artificial sequence
  Affy probe set ID: 217904_s_at
gggacctggttatgttgttattctc

SEQ ID NO: 2608 - DNA, 571 bp, Artificial sequence
  Target_Sequence, Fragment of GenBank Accession No. NM_001957
gtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccat

SEQ ID NO: 2609 - DNA, 25 bp, Artificial sequence
  Affy probe set ID: 204464_s_at
gtcatattgtttcctgtgctggagc

SEQ ID NO: 2610 - DNA, 25 bp, Artificial sequence
  Affy probe set ID: 204464_s_at
tgatatttctttcagacttcgccag

SEQ ID NO: 2611 - DNA, 25 bp, Artificial sequence
  Affy probe set ID: 204464_s_at
gacttcgccagacagattgctgata

SEQ ID NO: 2612 - DNA, 25 bp, Artificial sequence
  Affy probe set ID: 204464_s_at
ataacatcaggttccagttgcttga

SEQ ID NO: 2613 - DNA, 25 bp, Artificial sequence
  Affy probe set ID: 204464_s_at
aagaagtactgcccttttgtgtgtt

SEQ ID NO: 2614 - DNA, 25 bp, Artificial sequence
  Affy probe set ID: 204464_s_at
ttattccactggcgcatcatatgca

SEQ ID NO: 2615 - DNA, 25 bp, Artificial sequence
  Affy probe set ID: 204464_s_at
ggttcacaccattttgtttagacaa

SEQ ID NO: 2616 - DNA, 25 bp, Artificial sequence
  Affy probe set ID: 204464_s_at
aggcgtcaacgtgcattttatttat

SEQ ID NO: 2617 - DNA, 25 bp, Artificial sequence
  Affy probe set ID: 204464_s_at
tttccaatttctacctttactacat

SEQ ID NO: 2618 - DNA, 25 bp, Artificial sequence
  Affy probe set ID: 204464_s_at
ctacctttactacatcttttcaaca

SEQ ID NO: 2619 - DNA, 25 bp, Artificial sequence
  Affy probe set ID: 204464_s_at
aggccctgagttggcagtggcccat

SEQ ID NO: 2620 - DNA, 506 bp, Artificial sequence
  Target_Sequence, Fragment of GenBank Accession No. NM_138455
aattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttg

SEQ ID NO: 2621 - DNA, 25 bp, Artificial sequence
  Affy probe set ID: 225681_at
aattaatattcatcgcacttcttct

SEQ ID NO: 2622 - DNA, 25 bp, Artificial sequence
  Affy probe set ID: 225681_at
tattcatcgcacttcttctgtggaa

SEQ ID NO: 2623 - DNA, 25 bp, Artificial sequence
  Affy probe set ID: 225681_at
tggtgctggattagtggatgttgct

SEQ ID NO: 2624 - DNA, 25 bp, Artificial sequence
  Affy probe set ID: 225681_at
ggatgttgctatctgggttggcact

SEQ ID NO: 2625 - DNA, 25 bp, Artificial sequence
  Affy probe set ID: 225681_at
ggttggcacttgttcagattaccca

SEQ ID NO: 2626 - DNA, 25 bp, Artificial sequence
  Affy probe set ID: 225681_at
gagatgcttctactggatggaattc

SEQ ID NO: 2627 - DNA, 25 bp, Artificial sequence
  Affy probe set ID: 225681_at
ggaattcagtttctcgcatcattat

SEQ ID NO: 2628 - DNA, 25 bp, Artificial sequence
  Affy probe set ID: 225681_at
ttatgccttggaatggttcacttaa

SEQ ID NO: 2629 - DNA, 25 bp, Artificial sequence
  Affy probe set ID: 225681_at
ctttcttcatagtcacattctctca

SEQ ID NO: 2630 - DNA, 25 bp, Artificial sequence
  Affy probe set ID: 225681_at
cacattctctcaacctataatttgg

SEQ ID NO: 2631 - DNA, 25 bp, Artificial sequence
  Affy probe set ID: 225681_at
aagctaccaatctttgtacaatttg

SEQ ID NO: 2632 - DNA, 518 bp, Artificial sequence
  Target_Sequence, Fragment of GenBank Accession No. NM_001331
gccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataa

SEQ ID NO: 2633 - DNA, 25 bp, Artificial sequence
  Affy probe set ID: 208407_s_at
gccccaactctttatcaagcaacat

SEQ ID NO: 2634 - DNA, 25 bp, Artificial sequence
  Affy probe set ID: 208407_s_at
agttgaacatgggagcttattgcta

SEQ ID NO: 2635 - DNA, 25 bp, Artificial sequence
  Affy probe set ID: 208407_s_at
aggcccactgtaatacgtagctctc

SEQ ID NO: 2636 - DNA, 25 bp, Artificial sequence
  Affy probe set ID: 208407_s_at
actaccaatcccaactacgtaatag

SEQ ID NO: 2637 - DNA, 25 bp, Artificial sequence
  Affy probe set ID: 208407_s_at
agtactgaccactgggccataatgt

SEQ ID NO: 2638 - DNA, 25 bp, Artificial sequence
  Affy probe set ID: 208407_s_at
taatgttgcttctcaggctatatgc

SEQ ID NO: 2639 - DNA, 25 bp, Artificial sequence
  Affy probe set ID: 208407_s_at
ggctatatgcagtcctttagtcaga

SEQ ID NO: 2640 - DNA, 25 bp, Artificial sequence
  Affy probe set ID: 208407_s_at
tacagaccatattacctggattacc

SEQ ID NO: 2641 - DNA, 25 bp, Artificial sequence
  Affy probe set ID: 208407_s_at
taccagggactatctttgctgcaga

SEQ ID NO: 2642 - DNA, 25 bp, Artificial sequence
  Affy probe set ID: 208407_s_at
gatacttatttttctgaggtcctta

SEQ ID NO: 2643 - DNA, 25 bp, Artificial sequence
  Affy probe set ID: 208407_s_at
gaggtccttatgtcctgtcatataa

SEQ ID NO: 2644 - DNA, 523 bp, Artificial sequence
  Target_Sequence, Fragment of GenBank Accession No. NM_001613
aagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgt

SEQ ID NO: 2645 - DNA, 25 bp, Artificial sequence
  Affy probe set ID: 200974_at
aagagttacgagttgcctgatgggc

SEQ ID NO: 2646 - DNA, 25 bp, Artificial sequence
  Affy probe set ID: 200974_at
ttcatcgggatggagtctgctggca

SEQ ID NO: 2647 - DNA, 25 bp, Artificial sequence
  Affy probe set ID: 200974_at
ggcatccatgaaaccacctacaaca

SEQ ID NO: 2648 - DNA, 25 bp, Artificial sequence
  Affy probe set ID: 200974_at
ggaaggacctctatgctaacaatgt

SEQ ID NO: 2649 - DNA, 25 bp, Artificial sequence
  Affy probe set ID: 200974_at
tcctatcagggggcaccactatgta

SEQ ID NO: 2650 - DNA, 25 bp, Artificial sequence
  Affy probe set ID: 200974_at
gcagaaggagatcacggccctagca

SEQ ID NO: 2651 - DNA, 25 bp, Artificial sequence
  Affy probe set ID: 200974_at
aatacgatgaagccgggccttccat

SEQ ID NO: 2652 - DNA, 25 bp, Artificial sequence
  Affy probe set ID: 200974_at
aatgcttctaaaacactttcctgct

SEQ ID NO: 2653 - DNA, 25 bp, Artificial sequence
  Affy probe set ID: 200974_at
ctctgtctctagcacacaactgtga

SEQ ID NO: 2654 - DNA, 25 bp, Artificial sequence
  Affy probe set ID: 200974_at
gtggaattatgccttcagttctttt

SEQ ID NO: 2655 - DNA, 25 bp, Artificial sequence
  Affy probe set ID: 200974_at
attcctagccaaagctctgactcgt

SEQ ID NO: 2656 - DNA, 441 bp, Artificial sequence
  Target_Sequence, Fragment of GenBank Accession No. NM_002192
aaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagc

SEQ ID NO: 2657 - DNA, 25 bp, Artificial sequence
  Affy probe set ID: 210511_s_at
aaaggagcagtcgcacagacctttc

SEQ ID NO: 2658 - DNA, 25 bp, Artificial sequence
  Affy probe set ID: 210511_s_at
cagtttcaaggacatcggctggaat

SEQ ID NO: 2659 - DNA, 25 bp, Artificial sequence
  Affy probe set ID: 210511_s_at
tccctctggctatcatgccaactac

SEQ ID NO: 2660 - DNA, 25 bp, Artificial sequence
  Affy probe set ID: 210511_s_at
gctatcatgccaactactgcgaggg

SEQ ID NO: 2661 - DNA, 25 bp, Artificial sequence
  Affy probe set ID: 210511_s_at
tactgcgagggtgagtgcccgagcc

SEQ ID NO: 2662 - DNA, 25 bp, Artificial sequence
  Affy probe set ID: 210511_s_at
gccatatagcaggcacgtccgggtc

SEQ ID NO: 2663 - DNA, 25 bp, Artificial sequence
  Affy probe set ID: 210511_s_at
ttccactcaacagtcatcaaccact

SEQ ID NO: 2664 - DNA, 25 bp, Artificial sequence
  Affy probe set ID: 210511_s_at
tttgccaacctcaaatcgtgctgtg

SEQ ID NO: 2665 - DNA, 25 bp, Artificial sequence
  Affy probe set ID: 210511_s_at
gagacccatgtccatgttgtactat

SEQ ID NO: 2666 - DNA, 25 bp, Artificial sequence
  Affy probe set ID: 210511_s_at
atgatcgtggaggagtgtgggtgct

SEQ ID NO: 2667 - DNA, 25 bp, Artificial sequence
  Affy probe set ID: 210511_s_at
gtgggtgctcatagagttgcccagc

SEQ ID NO: 2668 - DNA, 502 bp, Artificial sequence
  Target_Sequence, Fragment of GenBank Accession No. NM_000935
ttatcaagtgtcaagatcagcaagtgtccttaagtcaaataggtttttttttgttggtggttgtgcttgctttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattcttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgtt

SEQ ID NO: 2669 - DNA, 25 bp, Artificial sequence
  Affy probe set ID: 202620_s_at
ttatcaagtgtcaagatcagcaagt

SEQ ID NO: 2670 - DNA, 25 bp, Artificial sequence
  Affy probe set ID: 202620_s_at
gatcagcaagtgtccttaagtcaaa

SEQ ID NO: 2671 - DNA, 25 bp, Artificial sequence
  Affy probe set ID: 202620_s_at
aaagttgttgagccttgcttcttcc

SEQ ID NO: 2672 - DNA, 25 bp, Artificial sequence
  Affy probe set ID: 202620_s_at
ttatcttcctggcataatttccatt

SEQ ID NO: 2673 - DNA, 25 bp, Artificial sequence
  Affy probe set ID: 202620_s_at
tccattttattcttctgagtgtcta

SEQ ID NO: 2674 - DNA, 25 bp, Artificial sequence
  Affy probe set ID: 202620_s_at
tctgagtgtctatgttaacttccct

SEQ ID NO: 2675 - DNA, 25 bp, Artificial sequence
  Affy probe set ID: 202620_s_at
tgttgacttgatgttttatcacttc

SEQ ID NO: 2676 - DNA, 25 bp, Artificial sequence
  Affy probe set ID: 202620_s_at
ttatcacttctctaagtaaggttga

SEQ ID NO: 2677 - DNA, 25 bp, Artificial sequence
  Affy probe set ID: 202620_s_at
aagaaattcttaatcacggtgccaa

SEQ ID NO: 2678 - DNA, 25 bp, Artificial sequence
  Affy probe set ID: 202620_s_at
aatcacggtgccaaaattcattttc

SEQ ID NO: 2679 - DNA, 25 bp, Artificial sequence
  Affy probe set ID: 202620_s_at
aattcattttctaacaccatgtgtt

SEQ ID NO: 2680 - DNA, 518 bp, Artificial sequence
  Target_Sequence, Fragment of GenBank Accession No. NM_015170
gtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgactt

SEQ ID NO: 2681 - DNA, 25 bp, Artificial sequence
  Affy probe set ID: 212354_at
gtgtgcacacggagactcatcgtta

SEQ ID NO: 2682 - DNA, 25 bp, Artificial sequence
  Affy probe set ID: 212354_at
ggatatttgggttggcttggttttg

SEQ ID NO: 2683 - DNA, 25 bp, Artificial sequence
  Affy probe set ID: 212354_at
atggtgcctttctgagtgtctaaaa

SEQ ID NO: 2684 - DNA, 25 bp, Artificial sequence
  Affy probe set ID: 212354_at
cttgacacccctggtaaatctttca

SEQ ID NO: 2685 - DNA, 25 bp, Artificial sequence
  Affy probe set ID: 212354_at
gtaaatctttcaacacacttccact

SEQ ID NO: 2686 - DNA, 25 bp, Artificial sequence
  Affy probe set ID: 212354_at
ttccactgcctgcgtaatgaagttt

SEQ ID NO: 2687 - DNA, 25 bp, Artificial sequence
  Affy probe set ID: 212354_at
accactggaatttttcaatgccgtc

SEQ ID NO: 2688 - DNA, 25 bp, Artificial sequence
  Affy probe set ID: 212354_at
tttttacaggcttatcagtctcact

SEQ ID NO: 2689 - DNA, 25 bp, Artificial sequence
  Affy probe set ID: 212354_at
atcagtctcactgttggctgtcatt

SEQ ID NO: 2690 - DNA, 25 bp, Artificial sequence
  Affy probe set ID: 212354_at
ggacgacacacagtatggatcacat

SEQ ID NO: 2691 - DNA, 25 bp, Artificial sequence
  Affy probe set ID: 212354_at
tgttgcatgtgttttacctcgactt

SEQ ID NO: 2692 - DNA, 587 bp, Artificial sequence
  Target_Sequence, Fragment of GenBank Accession No. NM_006039
ccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagag

SEQ ID NO: 2693 - DNA, 25 bp, Artificial sequence
  Affy probe set ID: 37408_at
ccatcactcctgtgcctgctggggt

SEQ ID NO: 2694 - DNA, 25 bp, Artificial sequence
  Affy probe set ID: 37408_at
tgtctgctgggctggagataagact

SEQ ID NO: 2695 - DNA, 25 bp, Artificial sequence
  Affy probe set ID: 37408_at
agggcccagagttcaccctctagtg

SEQ ID NO: 2696 - DNA, 25 bp, Artificial sequence
  Affy probe set ID: 37408_at
cagagttcaccctctagtggatcca

SEQ ID NO: 2697 - DNA, 25 bp, Artificial sequence
  Affy probe set ID: 37408_at
tcaccctctagtggatccaggagga

SEQ ID NO: 2698 - DNA, 25 bp, Artificial sequence
  Affy probe set ID: 37408_at
tctagtggatccaggaggagcagca

SEQ ID NO: 2699 - DNA, 25 bp, Artificial sequence
  Affy probe set ID: 37408_at
acccgagccctggagtggcccagta

SEQ ID NO: 2700 - DNA, 25 bp, Artificial sequence
  Affy probe set ID: 37408_at
gagtggcccagtacccttccaagag

SEQ ID NO: 2701 - DNA, 25 bp, Artificial sequence
  Affy probe set ID: 37408_at
agtcccagccaggacaaagtatgcg

SEQ ID NO: 2702 - DNA, 25 bp, Artificial sequence
  Affy probe set ID: 37408_at
agccaggacaaagtatgcggcccat

SEQ ID NO: 2703 - DNA, 25 bp, Artificial sequence
  Affy probe set ID: 37408_at
gtatgcggcccatcctggtgcgaca

SEQ ID NO: 2704 - DNA, 25 bp, Artificial sequence
  Affy probe set ID: 37408_at
tcctggtgcgacagcgtgggacaat

SEQ ID NO: 2705 - DNA, 25 bp, Artificial sequence
  Affy probe set ID: 37408_at
tgtgaacatggactcgaagacatgg

SEQ ID NO: 2706 - DNA, 25 bp, Artificial sequence
  Affy probe set ID: 37408_at
catggactcgaagacatggcccttt

SEQ ID NO: 2707 - DNA, 25 bp, Artificial sequence
  Affy probe set ID: 37408_at
gacatggccctttctctgtagttga

SEQ ID NO: 2708 - DNA, 25 bp, Artificial sequence
  Affy probe set ID: 37408_at
aacacctttaagaggcttgaaagag

SEQ ID NO: 2709 - DNA, 428 bp, Artificial sequence
  Target_Sequence, Fragment of GenBank Accession No. NM_005261
gaactaggctcatcagaatcgtgactattattgctccatcaaactgtgaaaagaaatgatgtggaccttgctggaaacaaaggcttagcaaacaatttttgttcaatgcccaccgagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaattttcataaaacatatagcataaaaacctccagtactttggttgacccttgtatgtcacagctctgctctatttattat

SEQ ID NO: 2710 - DNA, 25 bp, Artificial sequence
  Affy probe set ID: 204472_at
gaactaggctcatcagaatcgtgac

SEQ ID NO: 2711 - DNA, 25 bp, Artificial sequence
  Affy probe set ID: 204472_at
gaatcgtgactattattgctccatc

SEQ ID NO: 2712 - DNA, 25 bp, Artificial sequence
  Affy probe set ID: 204472_at
agaaatgatgtggaccttgctggaa

SEQ ID NO: 2713 - DNA, 25 bp, Artificial sequence
  Affy probe set ID: 204472_at
aacaatttttgttcaatgcccaccg

SEQ ID NO: 2714 - DNA, 25 bp, Artificial sequence
  Affy probe set ID: 204472_at
gttcaatgcccaccgagacatatag

SEQ ID NO: 2715 - DNA, 25 bp, Artificial sequence
  Affy probe set ID: 204472_at
tgatacatgtgtcccttataggctc

SEQ ID NO: 2716 - DNA, 25 bp, Artificial sequence
  Affy probe set ID: 204472_at
tatttagtcaaaccaccttttatgt

SEQ ID NO: 2717 - DNA, 25 bp, Artificial sequence
  Affy probe set ID: 204472_at
tatagcataaaaacctccagtactt

SEQ ID NO: 2718 - DNA, 25 bp, Artificial sequence
  Affy probe set ID: 204472_at
ctccagtactttggttgacccttgt

SEQ ID NO: 2719 - DNA, 25 bp, Artificial sequence
  Affy probe set ID: 204472_at
ggttgacccttgtatgtcacagctc

SEQ ID NO: 2720 - DNA, 25 bp, Artificial sequence
  Affy probe set ID: 204472_at
gtcacagctctgctctatttattat

SEQ ID NO: 2721 - DNA, 544 bp, Artificial sequence
  Target_Sequence, Fragment of GenBank Accession No. NM_001008707
taggctttactgtcttatgcttatggacattgtatatttgtattttatgaccaagtagaccaagtcagaaagatctctctcgagcgcaccataaacctgcagagagaagtctcgaaaggctccaccaaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcacctttcaaaaacatttttgatgccatcaccagcctactgcagaagtgcagggcacagtaaacaccatgtattattgaagatgatctgttttgtatgtatccttgtca

SEQ ID NO: 2722 - DNA, 25 bp, Artificial sequence
  Affy probe set ID: 204797_s_at
taggctttactgtcttatgcttatg

SEQ ID NO: 2723 - DNA, 25 bp, Artificial sequence
  Affy probe set ID: 204797_s_at
gagagaagtctcgaaaggctccacc

SEQ ID NO: 2724 - DNA, 25 bp, Artificial sequence
  Affy probe set ID: 204797_s_at
gctccaccaaggtaccaagggcagc

SEQ ID NO: 2725 - DNA, 25 bp, Artificial sequence
  Affy probe set ID: 204797_s_at
tcctgtcttttgtgcatgggcgacc

SEQ ID NO: 2726 - DNA, 25 bp, Artificial sequence
  Affy probe set ID: 204797_s_at
atgggcgacccattacagtatgaga

SEQ ID NO: 2727 - DNA, 25 bp, Artificial sequence
  Affy probe set ID: 204797_s_at
gattgagttctgatgcgttaaacgg

SEQ ID NO: 2728 - DNA, 25 bp, Artificial sequence
  Affy probe set ID: 204797_s_at
gaaggccttatccatttcgattgtg

SEQ ID NO: 2729 - DNA, 25 bp, Artificial sequence
  Affy probe set ID: 204797_s_at
aagatttttactcattcaaggcaag

SEQ ID NO: 2730 - DNA, 25 bp, Artificial sequence
  Affy probe set ID: 204797_s_at
atctgagctctatggcactggttgt

SEQ ID NO: 2731 - DNA, 25 bp, Artificial sequence
  Affy probe set ID: 204797_s_at
atcaccagcctactgcagaagtgca

SEQ ID NO: 2732 - DNA, 25 bp, Artificial sequence
  Affy probe set ID: 204797_s_at
atctgttttgtatgtatccttgtca

SEQ ID NO: 2733 - DNA, 427 bp, Artificial sequence
  Target_Sequence, Fragment of GenBank Accession No. NM_001031679
gaactgagtcaatatggcaaggtgtatgtgatctgtgggagttatgccatttaacataggaagtgcatgggactttccctctctgcactccagctcttactgtaccattagaagatgcagaattctgttggtgtgcaaaaagtatagccttacattcaagcagaatggatctgaagaaagcagcaatatctgttactagagaacattcccatgtgtttaaactcttcacttcttagatgcatttaaattcttaatgcaaatgacgtagcaatttgaaaacttctccgtattacttgtgtttaaaatgtcttgctttaaatacaaaacaaatggtaaaggggattatcttttgtttagatggttaaatattatttttgccttagatagctttgtaataatttttctccagacagttcaacacttttga

SEQ ID NO: 2734 - DNA, 25 bp, Artificial sequence
  Affy probe set ID: 225782_at
gaactgagtcaatatggcaaggtgt

SEQ ID NO: 2735 - DNA, 25 bp, Artificial sequence
  Affy probe set ID: 225782_at
gcaaggtgtatgtgatctgtgggag

SEQ ID NO: 2736 - DNA, 25 bp, Artificial sequence
  Affy probe set ID: 225782_at
gatctgtgggagttatgccatttaa

SEQ ID NO: 2737 - DNA, 25 bp, Artificial sequence
  Affy probe set ID: 225782_at
taggaagtgcatgggactttccctc

SEQ ID NO: 2738 - DNA, 25 bp, Artificial sequence
  Affy probe set ID: 225782_at
actccagctcttactgtaccattag

SEQ ID NO: 2739 - DNA, 25 bp, Artificial sequence
  Affy probe set ID: 225782_at
aagtatagccttacattcaagcaga

SEQ ID NO: 2740 - DNA, 25 bp, Artificial sequence
  Affy probe set ID: 225782_at
gaacattcccatgtgtttaaactct

SEQ ID NO: 2741 - DNA, 25 bp, Artificial sequence
  Affy probe set ID: 225782_at
aaactcttcacttcttagatgcatt

SEQ ID NO: 2742 - DNA, 25 bp, Artificial sequence
  Affy probe set ID: 225782_at
gaaaacttctccgtattacttgtgt

SEQ ID NO: 2743 - DNA, 25 bp, Artificial sequence
  Affy probe set ID: 225782_at
tatttttgccttagatagctttgta

SEQ ID NO: 2744 - DNA, 25 bp, Artificial sequence
  Affy probe set ID: 225782_at
tctccagacagttcaacacttttga

SEQ ID NO: 2745 - DNA, 510 bp, Artificial sequence
  Target_Sequence, Fragment of GenBank Accession No. NM_001004125
  misc_feature (31)..(32): n is a, c, g, or t
  misc_feature (163)..(163): n is a, c, g, or t
  misc_feature (255)..(255): n is a, c, g, or t
  misc_feature (297)..(297): n is a, c, g, or t
ccgcttggtggaggtcgagtgggtgcaaggnncctcaggacctcccacatgtacagttcccctgcctcttgccccggctagtttccctggagagaggcctagccaacaacgaagggacggattttaaaacagcgagaactgggtgccaagaaacacttcatantccctgaacttttctggatgttgtgcgaacctgttgtatttttttttttcctgtattttggttctgagggatgagtaatgtgtttttagttngttgagtttatccattcttcaatcccctaaagccttcagctnttctttcatatgtggccaacattttaagtacagtgtttgcttttataagtcggtgttacttggatgtcctataaaatacccactttttataaagatgatatttataacctaggaactcatgcctgtcttggctgcagtccctgtacatctaatatatactgatttgtttgcccccagagaatttttaaggtatctgcctatatcgtgatcttt

SEQ ID NO: 2746 - DNA, 25 bp, Artificial sequence
  Affy probe set ID: 227388_at
ccgcttggtggaggtcgagtgggtg

SEQ ID NO: 2747 - DNA, 25 bp, Artificial sequence
  Affy probe set ID: 227388_at
gagaggcctagccaacaacgaaggg

SEQ ID NO: 2748 - DNA, 25 bp, Artificial sequence
  Affy probe set ID: 227388_at
ggatgttgtgcgaacctgttgtatt

SEQ ID NO: 2749 - DNA, 25 bp, Artificial sequence
  Affy probe set ID: 227388_at
ttttttcctgtattttggttctgag

SEQ ID NO: 2750 - DNA, 25 bp, Artificial sequence
  Affy probe set ID: 227388_at
tgagtttatccattcttcaatcccc

SEQ ID NO: 2751 - DNA, 25 bp, Artificial sequence
  Affy probe set ID: 227388_at
agtcggtgttacttggatgtcctat

SEQ ID NO: 2752 - DNA, 25 bp, Artificial sequence
  Affy probe set ID: 227388_at
ggatgtcctataaaatacccacttt

SEQ ID NO: 2753 - DNA, 25 bp, Artificial sequence
  Affy probe set ID: 227388_at
cctaggaactcatgcctgtcttggc

SEQ ID NO: 2754 - DNA, 25 bp, Artificial sequence
  Affy probe set ID: 227388_at
ctgcagtccctgtacatctaatata

SEQ ID NO: 2755 - DNA, 25 bp, Artificial sequence
  Affy probe set ID: 227388_at
atatatactgatttgtttgccccca

SEQ ID NO: 2756 - DNA, 25 bp, Artificial sequence
  Affy probe set ID: 227388_at
ggtatctgcctatatcgtgatcttt

SEQ ID NO: 2757 - DNA, 421 bp, Artificial sequence
  Target_Sequence, Fragment of GenBank Accession No. NM_005965
gagccattggaagactgtcctctatggcaatgatctcagggctcagtggcaggaaatcctcaacagggtcaccaaccagcccgctcaatgcagaaaaactagaatctgaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcac

SEQ ID NO: 2758 - DNA, 25 bp, Artificial sequence
  Affy probe set ID: 202555_s_at
gagccattggaagactgtcctctat

SEQ ID NO: 2759 - DNA, 25 bp, Artificial sequence
  Affy probe set ID: 202555_s_at
ggcaatgatctcagggctcagtggc

SEQ ID NO: 2760 - DNA, 25 bp, Artificial sequence
  Affy probe set ID: 202555_s_at
accagcccgctcaatgcagaaaaac

SEQ ID NO: 2761 - DNA, 25 bp, Artificial sequence
  Affy probe set ID: 202555_s_at
atttctctaagaccattcgcgattt

SEQ ID NO: 2762 - DNA, 25 bp, Artificial sequence
  Affy probe set ID: 202555_s_at
cagaccccgaggttgtctggttcaa

SEQ ID NO: 2763 - DNA, 25 bp, Artificial sequence
  Affy probe set ID: 202555_s_at
tgaccagtcaatcagggagtcccgc

SEQ ID NO: 2764 - DNA, 25 bp, Artificial sequence
  Affy probe set ID: 202555_s_at
ccgccacttccagatagactacgat

SEQ ID NO: 2765 - DNA, 25 bp, Artificial sequence
  Affy probe set ID: 202555_s_at
ggacgggaactgctctttaattatt

SEQ ID NO: 2766 - DNA, 25 bp, Artificial sequence
  Affy probe set ID: 202555_s_at
gggatgacgatgccaagtacacctg

SEQ ID NO: 2767 - DNA, 25 bp, Artificial sequence
  Affy probe set ID: 202555_s_at
gtacacctgcaaggctgtcaacagt

SEQ ID NO: 2768 - DNA, 25 bp, Artificial sequence
  Affy probe set ID: 202555_s_at
acagtcttggagaagccacctgcac

SEQ ID NO: 2769 - DNA, 495 bp, Artificial sequence
  Target_Sequence, Fragment of GenBank Accession No. NM_016205
gtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgact

SEQ ID NO: 2770 - DNA, 25 bp, Artificial sequence
  Affy probe set ID: 218718_at
gtatttcattctcgtatggtgctag

SEQ ID NO: 2771 - DNA, 25 bp, Artificial sequence
  Affy probe set ID: 218718_at
aattatcatatcttccattcctgtt

SEQ ID NO: 2772 - DNA, 25 bp, Artificial sequence
  Affy probe set ID: 218718_at
aagtagacattcagatccagccatt

SEQ ID NO: 2773 - DNA, 25 bp, Artificial sequence
  Affy probe set ID: 218718_at
agatccagccattactaacctattc

SEQ ID NO: 2774 - DNA, 25 bp, Artificial sequence
  Affy probe set ID: 218718_at
gaaaaagacttggcagcttcctgat

SEQ ID NO: 2775 - DNA, 25 bp, Artificial sequence
  Affy probe set ID: 218718_at
gataaagcgtgctgtgctgtgcagt

SEQ ID NO: 2776 - DNA, 25 bp, Artificial sequence
  Affy probe set ID: 218718_at
taaactctgttccatacacttgtat

SEQ ID NO: 2777 - DNA, 25 bp, Artificial sequence
  Affy probe set ID: 218718_at
cagaagtatgtctcttaaccagttc

SEQ ID NO: 2778 - DNA, 25 bp, Artificial sequence
  Affy probe set ID: 218718_at
taaccagttcacttattgtactctg

SEQ ID NO: 2779 - DNA, 25 bp, Artificial sequence
  Affy probe set ID: 218718_at
aaatgcttaatatcgtgcctaggtt

SEQ ID NO: 2780 - DNA, 25 bp, Artificial sequence
  Affy probe set ID: 218718_at
atcgtgcctaggttatgtggtgact

SEQ ID NO: 2781 - DNA, 446 bp, Artificial sequence
  Target_Sequence, Fragment of GenBank Accession No. NM_015976
gtggaatgtgctaataatgccctgaaagcagattgggagagatggaaacaaaatatgcaaaatgatatcaagttagcatttacagatatggctgaggagaatatccattattatgaacagtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaat

SEQ ID NO: 2782 - DNA, 25 bp, Artificial sequence
  Affy probe set ID: 205573_s_at
gtggaatgtgctaataatgccctga

SEQ ID NO: 2783 - DNA, 25 bp, Artificial sequence
  Affy probe set ID: 205573_s_at
gaacagtgccttgctacgtgggaat

SEQ ID NO: 2784 - DNA, 25 bp, Artificial sequence
  Affy probe set ID: 205573_s_at
ggaatcattccttacatcacagacc

SEQ ID NO: 2785 - DNA, 25 bp, Artificial sequence
  Affy probe set ID: 205573_s_at
cacagaccaaccttcacttggaaga

SEQ ID NO: 2786 - DNA, 25 bp, Artificial sequence
  Affy probe set ID: 205573_s_at
accttaatcccattgaggacttctg

SEQ ID NO: 2787 - DNA, 25 bp, Artificial sequence
  Affy probe set ID: 205573_s_at
aggacttctgtttgatctttgggag

SEQ ID NO: 2788 - DNA, 25 bp, Artificial sequence
  Affy probe set ID: 205573_s_at
aagttattctttctggatctgccgt

SEQ ID NO: 2789 - DNA, 25 bp, Artificial sequence
  Affy probe set ID: 205573_s_at
ggatctgccgtgtccttataaagtg

SEQ ID NO: 2790 - DNA, 25 bp, Artificial sequence
  Affy probe set ID: 205573_s_at
gaaaaatgttttgtacccatctgga

SEQ ID NO: 2791 - DNA, 25 bp, Artificial sequence
  Affy probe set ID: 205573_s_at
caggtattccaggtcactgacatga

SEQ ID NO: 2792 - DNA, 25 bp, Artificial sequence
  Affy probe set ID: 205573_s_at
gagagatatctggcttggttttaat

SEQ ID NO: 2793 - DNA, 516 bp, Artificial sequence
  Target_Sequence, Fragment of GenBank Accession No. NM_130830
  misc_feature (262)..(262): n is a, c, g, or t
  misc_feature (464)..(464): n is a, c, g, or t
tttccacaacctttcagatgctgatgtagagctattgggaaagaacttccaaactcaggaagtttgcagagagcagacagctagagataactcgggacccagagttggtcgacagatgttagatgtatcctagcttttagctataaaccactcaaagattcagcccccagatcccacagtcagaactgaatctgcgttgttgggaagccagcagtggccttgggaaggaagccatggctgtggttcagagagggtgggctgncaagccacttccggggaaaactccttccgccccaggtttcttcttctcttaaggagagattgttctcaccaacccgctgccttcatgctgccttcaaagctagatcatgtttgccttgcttagagaattactgcaaatcagccccagtgcttggcgatgcatttacagatttctaggccctcagggttttgtagagtgtganccctggtgggcagggttggggggtctgtcttctgctggatgctgcttgtaat

SEQ ID NO: 2794 - DNA, 25 bp, Artificial sequence
  Affy probe set ID: 213909_at
tttccacaacctttcagatgctgat

SEQ ID NO: 2795 - DNA, 25 bp, Artificial sequence
  Affy probe set ID: 213909_at
taaaccactcaaagattcagccccc

SEQ ID NO: 2796 - DNA, 25 bp, Artificial sequence
  Affy probe set ID: 213909_at
ccccagatcccacagtcagaactga

SEQ ID NO: 2797 - DNA, 25 bp, Artificial sequence
  Affy probe set ID: 213909_at
gaatctgcgttgttgggaagccagc

SEQ ID NO: 2798 - DNA, 25 bp, Artificial sequence
  Affy probe set ID: 213909_at
aggagagattgttctcaccaacccg

SEQ ID NO: 2799 - DNA, 25 bp, Artificial sequence
  Affy probe set ID: 213909_at
ccttcatgctgccttcaaagctaga

SEQ ID NO: 2800 - DNA, 25 bp, Artificial sequence
  Affy probe set ID: 213909_at
gctagatcatgtttgccttgcttag

SEQ ID NO: 2801 - DNA, 25 bp, Artificial sequence
  Affy probe set ID: 213909_at
attactgcaaatcagccccagtgct

SEQ ID NO: 2802 - DNA, 25 bp, Artificial sequence
  Affy probe set ID: 213909_at
ccccagtgcttggcgatgcatttac

SEQ ID NO: 2803 - DNA, 25 bp, Artificial sequence
  Affy probe set ID: 213909_at
gcatttacagatttctaggccctca

SEQ ID NO: 2804 - DNA, 25 bp, Artificial sequence
  Affy probe set ID: 213909_at
tcttctgctggatgctgcttgtaat

SEQ ID NO: 2805 - DNA, 350 bp, Artificial sequence
  Target_Sequence, Fragment of GenBank Accession No. NM_002026
  misc_feature (90)..(90): n is a, c, g, or t
  misc_feature (124)..(124): n is a, c, g, or t
  misc_feature (143)..(143): n is a, c, g, or t
  misc_feature (150)..(150): n is a, c, g, or t
  misc_feature (157)..(158): n is a, c, g, or t
  misc_feature (162)..(163): n is a, c, g, or t
  misc_feature (168)..(168): n is a, c, g, or t
  misc_feature (223)..(223): n is a, c, g, or t
cttctccaagcatcaccctgggagtttcctgagggttttctcataaatgagggctgcacattgcctgttctgcttcgaagtattcaatanccgctcagtattttaaatgaagtgattctaagantttggtttgggatcaatanggaaagncatatgnncagnnccaanccaagatgcaaatgttttgaaatgatatgaccaaaattttaagtaggaaagtcancccaaacacttctgctttcacttaagtgtctggcccgcaatactgtaggaacaagcatgatcttgttactgtgatattttaaatatccacagtactcactttttccaaatgatcctagtaattgcct

SEQ ID NO: 2806 - DNA, 25 bp, Artificial sequence
  Affy probe set ID: 212464_s_at
cttctccaagcatcaccctgggagt

SEQ ID NO: 2807 - DNA, 25 bp, Artificial sequence
  Affy probe set ID: 212464_s_at
aagcatcaccctgggagtttcctga

SEQ ID NO: 2808 - DNA, 25 bp, Artificial sequence
  Affy probe set ID: 212464_s_at
ggagtttcctgagggttttctcata

SEQ ID NO: 2809 - DNA, 25 bp, Artificial sequence
  Affy probe set ID: 212464_s_at
aaatgagggctgcacattgcctgtt

SEQ ID NO: 2810 - DNA, 25 bp, Artificial sequence
  Affy probe set ID: 212464_s_at
ctgttctgcttcgaagtattcaata

SEQ ID NO: 2811 - DNA, 25 bp, Artificial sequence
  Affy probe set ID: 212464_s_at
ccaaacacttctgctttcacttaag

SEQ ID NO: 2812 - DNA, 25 bp, Artificial sequence
  Affy probe set ID: 212464_s_at
tgctttcacttaagtgtctggcccg

SEQ ID NO: 2813 - DNA, 25 bp, Artificial sequence
  Affy probe set ID: 212464_s_at
gtctggcccgcaatactgtaggaac

SEQ ID NO: 2814 - DNA, 25 bp, Artificial sequence
  Affy probe set ID: 212464_s_at
agcatgatcttgttactgtgatatt

SEQ ID NO: 2815 - DNA, 25 bp, Artificial sequence
  Affy probe set ID: 212464_s_at
tatccacagtactcactttttccaa

SEQ ID NO: 2816 - DNA, 25 bp, Artificial sequence
  Affy probe set ID: 212464_s_at
ttccaaatgatcctagtaattgcct

SEQ ID NO: 2817 - DNA, 516 bp, Artificial sequence
  Target_Sequence, Fragment of GenBank Accession No. NM_006855
tgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaa

SEQ ID NO: 2818 - DNA, 25 bp, Artificial sequence
  Affy probe set ID: 204017_at
tgagcaagtcaaccccaatctggaa

SEQ ID NO: 2819 - DNA, 25 bp, Artificial sequence
  Affy probe set ID: 204017_at
caatctggaacaatgtccctcctct

SEQ ID NO: 2820 - DNA, 25 bp, Artificial sequence
  Affy probe set ID: 204017_at
gaatttccactttccaggtagatga

SEQ ID NO: 2821 - DNA, 25 bp, Artificial sequence
  Affy probe set ID: 204017_at
tttcacactgccttcaggccagaag

SEQ ID NO: 2822 - DNA, 25 bp, Artificial sequence
  Affy probe set ID: 204017_at
ttgtgactcatcttttactggtttg

SEQ ID NO: 2823 - DNA, 25 bp, Artificial sequence
  Affy probe set ID: 204017_at
gatacctgccttgtacttagtacct

SEQ ID NO: 2824 - DNA, 25 bp, Artificial sequence
  Affy probe set ID: 204017_at
ttaggcgagtaccatttgcacaatc

SEQ ID NO: 2825 - DNA, 25 bp, Artificial sequence
  Affy probe set ID: 204017_at
acccttacctactaggtatcctgct

SEQ ID NO: 2826 - DNA, 25 bp, Artificial sequence
  Affy probe set ID: 204017_at
tatcctgctagggttttcaattcca

SEQ ID NO: 2827 - DNA, 25 bp, Artificial sequence
  Affy probe set ID: 204017_at
agtaatcagtcaatccaatatcccc

SEQ ID NO: 2828 - DNA, 25 bp, Artificial sequence
  Affy probe set ID: 204017_at
atcccccatctttgtcttgaaacaa

SEQ ID NO: 2829 - DNA, 537 bp, Artificial sequence
  Target_Sequenc, Fragment of GenBank Accession No. NM_002292
caggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgccggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccg

SEQ ID NO: 2830 - DNA, 25 bp, Artificial sequence
  Affy probe set ID: 216264_s_at
caggtgcagagcgggcactgagctc

SEQ ID NO: 2831 - DNA, 25 bp, Artificial sequence
  Affy probe set ID: 216264_s_at
gaaagggctcggcagttggatgctc

SEQ ID NO: 2832 - DNA, 25 bp, Artificial sequence
  Affy probe set ID: 216264_s_at
agttggatgctctcctggaggctct

SEQ ID NO: 2833 - DNA, 25 bp, Artificial sequence
  Affy probe set ID: 216264_s_at
gaaatagtctggcagcctctacagc

SEQ ID NO: 2834 - DNA, 25 bp, Artificial sequence
  Affy probe set ID: 216264_s_at
cggtcctctgggtgatcagtaccag

SEQ ID NO: 2835 - DNA, 25 bp, Artificial sequence
  Affy probe set ID: 216264_s_at
agtaccagacggtgaaggccctagc

SEQ ID NO: 2836 - DNA, 25 bp, Artificial sequence
  Affy probe set ID: 216264_s_at
tgaaggccctagctgagcgcaaggc

SEQ ID NO: 2837 - DNA, 25 bp, Artificial sequence
  Affy probe set ID: 216264_s_at
gtgctggctgcacaggcaagggcag

SEQ ID NO: 2838 - DNA, 25 bp, Artificial sequence
  Affy probe set ID: 216264_s_at
ttgcaagccgctcaggacaagctgc

SEQ ID NO: 2839 - DNA, 25 bp, Artificial sequence
  Affy probe set ID: 216264_s_at
cacatgcatgtctgcctatgcactg

SEQ ID NO: 2840 - DNA, 25 bp, Artificial sequence
  Affy probe set ID: 216264_s_at
tatgcactgaagagctcttggcccg

SEQ ID NO: 2841 - DNA, 502 bp, Artificial sequence
  Target_Sequence, Fragment of GenBank Accession No. NM_002658
cccgaccggtgggcatttgtgaggcccatggttgagaaatgaataatttcccaattaggaagtgtaagcagctgaggtctcttgagggagcttagccaatgtgggagcagcggtttggggagcagagacactaacgacttcagggcagggctctgatattccatgaatgtatcaggaaatatatatgtgtgtgtatgtttgcacacttgttgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtacttattctgcagcatgacctgtgaccagcactgtctcagtttcactttcacatagatgtccctttcttggccagttatcccttccttttagcctagttcatccaatcctcactgggtgggg

SEQ ID NO: 2842 - DNA, 25 bp, Artificial sequence
  Affy probe set ID: 205479_s_at
cccgaccggtgggcatttgtgaggc

SEQ ID NO: 2843 - DNA, 25 bp, Artificial sequence
  Affy probe set ID: 205479_s_at
agcagctgaggtctcttgagggagc

SEQ ID NO: 2844 - DNA, 25 bp, Artificial sequence
  Affy probe set ID: 205479_s_at
tgggagcagcggtttggggagcaga

SEQ ID NO: 2845 - DNA, 25 bp, Artificial sequence
  Affy probe set ID: 205479_s_at
gacactaacgacttcagggcagggc

SEQ ID NO: 2846 - DNA, 25 bp, Artificial sequence
  Affy probe set ID: 205479_s_at
gcagggctctgatattccatgaatg

SEQ ID NO: 2847 - DNA, 25 bp, Artificial sequence
  Affy probe set ID: 205479_s_at
agaggttataggtcactcctggggc

SEQ ID NO: 2848 - DNA, 25 bp, Artificial sequence
  Affy probe set ID: 205479_s_at
cccccacgtgacagtgcctgggaat

SEQ ID NO: 2849 - DNA, 25 bp, Artificial sequence
  Affy probe set ID: 205479_s_at
cagcatgacctgtgaccagcactgt

SEQ ID NO: 2850 - DNA, 25 bp, Artificial sequence
  Affy probe set ID: 205479_s_at
tgaccagcactgtctcagtttcact

SEQ ID NO: 2851 - DNA, 25 bp, Artificial sequence
  Affy probe set ID: 205479_s_at
cttccttttagcctagttcatccaa

SEQ ID NO: 2852 - DNA, 25 bp, Artificial sequence
  Affy probe set ID: 205479_s_at
ttcatccaatcctcactgggtgggg

SEQ ID NO: 2853 - DNA, 343 bp, Artificial sequence
  Target_Sequence, Fragment of GenBank Accession No. NM_005529
tccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacg

SEQ ID NO: 2854 - DNA, 25 bp, Artificial sequence
  Affy probe set ID: 201655_s_at
tccctccctcaggggctgtaaggga

SEQ ID NO: 2855 - DNA, 25 bp, Artificial sequence
  Affy probe set ID: 201655_s_at
tcaggggctgtaagggaaggcccac

SEQ ID NO: 2856 - DNA, 25 bp, Artificial sequence
  Affy probe set ID: 201655_s_at
actcctccaacagacaacggacgga

SEQ ID NO: 2857 - DNA, 25 bp, Artificial sequence
  Affy probe set ID: 201655_s_at
gacaacggacggacggatgccgctg

SEQ ID NO: 2858 - DNA, 25 bp, Artificial sequence
  Affy probe set ID: 201655_s_at
atgccgctggtgctcaggaagagct

SEQ ID NO: 2859 - DNA, 25 bp, Artificial sequence
  Affy probe set ID: 201655_s_at
gctcaggaagagctagtgccttagg

SEQ ID NO: 2860 - DNA, 25 bp, Artificial sequence
  Affy probe set ID: 201655_s_at
ggaagagctagtgccttaggtgggg

SEQ ID NO: 2861 - DNA, 25 bp, Artificial sequence
  Affy probe set ID: 201655_s_at
agagctagtgccttaggtgggggaa

SEQ ID NO: 2862 - DNA, 25 bp, Artificial sequence
  Affy probe set ID: 201655_s_at
ggaaggcaggactcacgactgagag

SEQ ID NO: 2863 - DNA, 25 bp, Artificial sequence
  Affy probe set ID: 201655_s_at
ggcaggactcacgactgagagagag

SEQ ID NO: 2864 - DNA, 25 bp, Artificial sequence
  Affy probe set ID: 201655_s_at
gcccccagactgtggggttgggacg

SEQ ID NO: 2865 - DNA, 238 bp, Artificial sequence
  Target_Sequence, Fragment of GenBank Accession No. NM_001235
gacacatgggtgctattggggttgggggggaggtgaggtaccagccttggatactccatggaattcgagctccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaatt

SEQ ID NO: 2866 - DNA, 25 bp, Artificial sequence
  Affy probe set ID: 207714_s_at
gacacatgggtgctattggggttgg

SEQ ID NO: 2867 - DNA, 25 bp, Artificial sequence
  Affy probe set ID: 207714_s_at
tgggggggaggtgaggtaccagcct

SEQ ID NO: 2868 - DNA, 25 bp, Artificial sequence
  Affy probe set ID: 207714_s_at
aggtaccagccttggatactccatg

SEQ ID NO: 2869 - DNA, 25 bp, Artificial sequence
  Affy probe set ID: 207714_s_at
tggacatgggccccagataccatga

SEQ ID NO: 2870 - DNA, 25 bp, Artificial sequence
  Affy probe set ID: 207714_s_at
gataccatgatgctgagcccggaaa

SEQ ID NO: 2871 - DNA, 25 bp, Artificial sequence
  Affy probe set ID: 207714_s_at
cggaaactccacatcctgtgggacc

SEQ ID NO: 2872 - DNA, 25 bp, Artificial sequence
  Affy probe set ID: 207714_s_at
tgtgggacctgggccatagtcattc

SEQ ID NO: 2873 - DNA, 25 bp, Artificial sequence
  Affy probe set ID: 207714_s_at
ctgaaagtcccagatcaagcctgcc

SEQ ID NO: 2874 - DNA, 25 bp, Artificial sequence
  Affy probe set ID: 207714_s_at
caagcctgcctcaatcagtattcat

SEQ ID NO: 2875 - DNA, 25 bp, Artificial sequence
  Affy probe set ID: 207714_s_at
atttatagccaggtaccttctcacc

SEQ ID NO: 2876 - DNA, 25 bp, Artificial sequence
  Affy probe set ID: 207714_s_at
accttctcacctgtgagaccaaatt

SEQ ID NO: 2877 - DNA, 569 bp, Artificial sequence
  Target_Sequence, Fragment of GenBank Accession No. AJ318805
  misc_feature (79)..(79): n is a, c, g, or t
  misc_feature (286)..(286): n is a, c, g, or t
acacttatagtctactgcccatgtaaggatcagctccggctaagaggccaaagatgggtgacatcgttatgctctgccntttattttttctttcttacccacttagcttcctaattggaggaaggaggcgtggtaaaggtatatgaagactatggtttaattagaccagaaaacactgtcataatctctggggtcatcagaatgtccagttttgtctttgggccaagataagggcagtgggatttatgatgtgttgtttatagtctgaaactactctggtgatcanccagggtcagtttctttaatgatggtttccaactggcctaatacattaagtaagactggctgataacatgaccagacagacataaagaccctgttgggaatgacattgaactctcaaagtcaagatttcttacacaaatctatcagctggagaaaatgaaggcagtgtggtatatgtgtgcaaataaggacattatgaagcttaaatatggaatgtctcttggacccccgatgtcatctgtattctctttttcttcttgtactatatcctttgcctgtaaata

SEQ ID NO: 2878 - DNA, 25 bp, Artificial sequence
  Affy probe set ID: 227061_at
acacttatagtctactgcccatgta

SEQ ID NO: 2879 - DNA, 25 bp, Artificial sequence
  Affy probe set ID: 227061_at
actgcccatgtaaggatcagctccg

SEQ ID NO: 2880 - DNA, 25 bp, Artificial sequence
  Affy probe set ID: 227061_at
ggatcagctccggctaagaggccaa

SEQ ID NO: 2881 - DNA, 25 bp, Artificial sequence
  Affy probe set ID: 227061_at
gatgggtgacatcgttatgctctgc

SEQ ID NO: 2882 - DNA, 25 bp, Artificial sequence
  Affy probe set ID: 227061_at
actgtcataatctctggggtcatca

SEQ ID NO: 2883 - DNA, 25 bp, Artificial sequence
  Affy probe set ID: 227061_at
tagtctgaaactactctggtgatca

SEQ ID NO: 2884 - DNA, 25 bp, Artificial sequence
  Affy probe set ID: 227061_at
gatggtttccaactggcctaataca

SEQ ID NO: 2885 - DNA, 25 bp, Artificial sequence
  Affy probe set ID: 227061_at
ttcttacacaaatctatcagctgga

SEQ ID NO: 2886 - DNA, 25 bp, Artificial sequence
  Affy probe set ID: 227061_at
cccgatgtcatctgtattctctttt

SEQ ID NO: 2887 - DNA, 25 bp, Artificial sequence
  Affy probe set ID: 227061_at
ctctttttcttcttgtactatatcc

SEQ ID NO: 2888 - DNA, 25 bp, Artificial sequence
  Affy probe set ID: 227061_at
gtactatatcctttgcctgtaaata

SEQ ID NO: 2889 - DNA, 503 bp, Artificial sequence
  Target_Sequence, Fragment of GenBank Accession No. NM_000396
gaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattc

SEQ ID NO: 2890 - DNA, 25 bp, Artificial sequence
  Affy probe set ID: 202450_s_at
gaacaacgcctgtggcattgccaac

SEQ ID NO: 2891 - DNA, 25 bp, Artificial sequence
  Affy probe set ID: 202450_s_at
ttccatttcttccacgatggtgcag

SEQ ID NO: 2892 - DNA, 25 bp, Artificial sequence
  Affy probe set ID: 202450_s_at
tgagattgtctgttcagtttcccca

SEQ ID NO: 2893 - DNA, 25 bp, Artificial sequence
  Affy probe set ID: 202450_s_at
gtgcttcaaatgatccttcctactt

SEQ ID NO: 2894 - DNA, 25 bp, Artificial sequence
  Affy probe set ID: 202450_s_at
ccacccatgacctttttcactgtgg

SEQ ID NO: 2895 - DNA, 25 bp, Artificial sequence
  Affy probe set ID: 202450_s_at
atcaggactttccctgacagctgtg

SEQ ID NO: 2896 - DNA, 25 bp, Artificial sequence
  Affy probe set ID: 202450_s_at
gacagctgtgtactcttaggctaag

SEQ ID NO: 2897 - DNA, 25 bp, Artificial sequence
  Affy probe set ID: 202450_s_at
tgactgtgttgtcccagggctgatg

SEQ ID NO: 2898 - DNA, 25 bp, Artificial sequence
  Affy probe set ID: 202450_s_at
aggttagattctcattcacgggact

SEQ ID NO: 2899 - DNA, 25 bp, Artificial sequence
  Affy probe set ID: 202450_s_at
aagttcccttctatatcctcaaggt

SEQ ID NO: 2900 - DNA, 25 bp, Artificial sequence
  Affy probe set ID: 202450_s_at
atgtctatgttttctactccaattc

SEQ ID NO: 2901 - DNA, 364 bp, Artificial sequence
  Target_Sequence, Fragment of GenBank Accession No. NM_031302
catagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaacct

SEQ ID NO: 2902 - DNA, 25 bp, Artificial sequence
  Affy probe set ID: 227070_at
catagctgatataactctaccctta

SEQ ID NO: 2903 - DNA, 25 bp, Artificial sequence
  Affy probe set ID: 227070_at
tctacccttaaaatattccctgtat

SEQ ID NO: 2904 - DNA, 25 bp, Artificial sequence
  Affy probe set ID: 227070_at
aattgtccctttgtagccaactata

SEQ ID NO: 2905 - DNA, 25 bp, Artificial sequence
  Affy probe set ID: 227070_at
gtagccaactataacattgttcttt

SEQ ID NO: 2906 - DNA, 25 bp, Artificial sequence
  Affy probe set ID: 227070_at
ttacctttgatacatatgatccaca

SEQ ID NO: 2907 - DNA, 25 bp, Artificial sequence
  Affy probe set ID: 227070_at
tgtgtgcaaattataccttggacca

SEQ ID NO: 2908 - DNA, 25 bp, Artificial sequence
  Affy probe set ID: 227070_at
ttggaccatataggcattgattaac

SEQ ID NO: 2909 - DNA, 25 bp, Artificial sequence
  Affy probe set ID: 227070_at
gagacccatctagataacagcaatc

SEQ ID NO: 2910 - DNA, 25 bp, Artificial sequence
  Affy probe set ID: 227070_at
gcaatcaacctgcttaattctgaat

SEQ ID NO: 2911 - DNA, 25 bp, Artificial sequence
  Affy probe set ID: 227070_at
aaaacttctacatgtatttttcaca

SEQ ID NO: 2912 - DNA, 25 bp, Artificial sequence
  Affy probe set ID: 227070_at
gatctccttaacaggttgccaacct

SEQ ID NO: 2913 - DNA, 517 bp, Artificial sequence
  Target_Sequence, Fragment of GenBank Accession No. NM_080821
ggccattctctgatgcagggcacttgctccacactctgggaacccagattcaccagtctgccctgtcacgtagttgaaggagttgcatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaaggtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgtttaaagcaattccttggcttcggctc

SEQ ID NO: 2914 - DNA, 25 bp, Artificial sequence
  Affy probe set ID: 224690_at
ggccattctctgatgcagggcactt

SEQ ID NO: 2915 - DNA, 25 bp, Artificial sequence
  Affy probe set ID: 224690_at
gtctgccctgtcacgtagttgaagg

SEQ ID NO: 2916 - DNA, 25 bp, Artificial sequence
  Affy probe set ID: 224690_at
gttgcagaacctccacaaggctaaa

SEQ ID NO: 2917 - DNA, 25 bp, Artificial sequence
  Affy probe set ID: 224690_at
taactggccatcctggttttgcaga

SEQ ID NO: 2918 - DNA, 25 bp, Artificial sequence
  Affy probe set ID: 224690_at
agttatctccactaacatatccaag

SEQ ID NO: 2919 - DNA, 25 bp, Artificial sequence
  Affy probe set ID: 224690_at
tctttgtaggacaatttctccacct

SEQ ID NO: 2920 - DNA, 25 bp, Artificial sequence
  Affy probe set ID: 224690_at
ctccacctgcaaggtctttcaggta

SEQ ID NO: 2921 - DNA, 25 bp, Artificial sequence
  Affy probe set ID: 224690_at
gctgtctttctgagatctaattcca

SEQ ID NO: 2922 - DNA, 25 bp, Artificial sequence
  Affy probe set ID: 224690_at
ttccaaggacttctccacagctaag

SEQ ID NO: 2923 - DNA, 25 bp, Artificial sequence
  Affy probe set ID: 224690_at
gatgcctcacaccattaggtgatgc

SEQ ID NO: 2924 - DNA, 25 bp, Artificial sequence
  Affy probe set ID: 224690_at
taaagcaattccttggcttcggctc

SEQ ID NO: 2925 - DNA, 305 bp, Artificial sequence
  Target_Sequence, Fragment of GenBank Accession No. NM_002345
caaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggtaaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctct

SEQ ID NO: 2926 - DNA, 25 bp, Artificial sequence
  Affy probe set ID: 201744_s_at
caaatgatgtgcaaaaccttttact

SEQ ID NO: 2927 - DNA, 25 bp, Artificial sequence
  Affy probe set ID: 201744_s_at
accttttactggttgcatggaaatc

SEQ ID NO: 2928 - DNA, 25 bp, Artificial sequence
  Affy probe set ID: 201744_s_at
gaaatcagccaagttttataatcct

SEQ ID NO: 2929 - DNA, 25 bp, Artificial sequence
  Affy probe set ID: 201744_s_at
aatccttaaatcttaatgttcctca

SEQ ID NO: 2930 - DNA, 25 bp, Artificial sequence
  Affy probe set ID: 201744_s_at
taatgttcctcaaagcttggattaa

SEQ ID NO: 2931 - DNA, 25 bp, Artificial sequence
  Affy probe set ID: 201744_s_at
atacatatggatgttactctcttgc

SEQ ID NO: 2932 - DNA, 25 bp, Artificial sequence
  Affy probe set ID: 201744_s_at
taggtggtagatattgaggccaaga

SEQ ID NO: 2933 - DNA, 25 bp, Artificial sequence
  Affy probe set ID: 201744_s_at
aatacatgaagcttcatgcacttaa

SEQ ID NO: 2934 - DNA, 25 bp, Artificial sequence
  Affy probe set ID: 201744_s_at
aagaatttgcatacttacctagtga

SEQ ID NO: 2935 - DNA, 25 bp, Artificial sequence
  Affy probe set ID: 201744_s_at
gcatacttacctagtgaaacttttc

SEQ ID NO: 2936 - DNA, 25 bp, Artificial sequence
  Affy probe set ID: 201744_s_at
cactctaagtcatgtatgtttctct

SEQ ID NO: 2937 - DNA, 422 bp, Artificial sequence
  Target_Sequence, Fragment of GenBank Accession No. NM_005110
gtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcgactctgctc

SEQ ID NO: 2938 - DNA, 25 bp, Artificial sequence
  Affy probe set ID: 205100_at
gtatgtggctttctgtagccgtggt

SEQ ID NO: 2939 - DNA, 25 bp, Artificial sequence
  Affy probe set ID: 205100_at
taacggccaaactgttcatcctagc

SEQ ID NO: 2940 - DNA, 25 bp, Artificial sequence
  Affy probe set ID: 205100_at
tcctggcaggtggcattcatctcag

SEQ ID NO: 2941 - DNA, 25 bp, Artificial sequence
  Affy probe set ID: 205100_at
tgagcacaaggcattggccctctgg

SEQ ID NO: 2942 - DNA, 25 bp, Artificial sequence
  Affy probe set ID: 205100_at
aagtccagttgaaatctcagcctcc

SEQ ID NO: 2943 - DNA, 25 bp, Artificial sequence
  Affy probe set ID: 205100_at
caacattttcttctcgtgtgtggcc

SEQ ID NO: 2944 - DNA, 25 bp, Artificial sequence
  Affy probe set ID: 205100_at
ccacttctccaacttctgtttaatc

SEQ ID NO: 2945 - DNA, 25 bp, Artificial sequence
  Affy probe set ID: 205100_at
gtttaatctgatcacggctcttttt

SEQ ID NO: 2946 - DNA, 25 bp, Artificial sequence
  Affy probe set ID: 205100_at
ttaagccctggcagcattttggtcc

SEQ ID NO: 2947 - DNA, 25 bp, Artificial sequence
  Affy probe set ID: 205100_at
ctgctccttgcccatagtaaaacag

SEQ ID NO: 2948 - DNA, 25 bp, Artificial sequence
  Affy probe set ID: 205100_at
tagtttcaagtgggcgactctgctc

SEQ ID NO: 2949 - DNA, 490 bp, Artificial sequence
  Target_Sequence, Fragment of GenBank Accession No. NM_002941
acatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaa

SEQ ID NO: 2950 - DNA, 25 bp, Artificial sequence
  Affy probe set ID: 213194_at
acatgcatactttattgtgggccat

SEQ ID NO: 2951 - DNA, 25 bp, Artificial sequence
  Affy probe set ID: 213194_at
gttgtggccaatgtcgaaacctaca

SEQ ID NO: 2952 - DNA, 25 bp, Artificial sequence
  Affy probe set ID: 213194_at
gaggcattacttgctttcaattgac

SEQ ID NO: 2953 - DNA, 25 bp, Artificial sequence
  Affy probe set ID: 213194_at
gatgccctctgactagtagatttct

SEQ ID NO: 2954 - DNA, 25 bp, Artificial sequence
  Affy probe set ID: 213194_at
gtagatttctatgatccttttttgt

SEQ ID NO: 2955 - DNA, 25 bp, Artificial sequence
  Affy probe set ID: 213194_at
ataagtatcaggtctgaccccagtg

SEQ ID NO: 2956 - DNA, 25 bp, Artificial sequence
  Affy probe set ID: 213194_at
gttccatagaaaaggcgtgcagtac

SEQ ID NO: 2957 - DNA, 25 bp, Artificial sequence
  Affy probe set ID: 213194_at
ggcgtgcagtactaagggaacaatc

SEQ ID NO: 2958 - DNA, 25 bp, Artificial sequence
  Affy probe set ID: 213194_at
attatgttcatgtaagaagcccctt

SEQ ID NO: 2959 - DNA, 25 bp, Artificial sequence
  Affy probe set ID: 213194_at
gaagccccttatttttagccataat

SEQ ID NO: 2960 - DNA, 25 bp, Artificial sequence
  Affy probe set ID: 213194_at
tttagccataattttgcatactgaa

SEQ ID NO: 2961 - DNA, 447 bp, Artificial sequence
  Target_Sequence, Fragment of GenBank Accession No. NM_005429
cccagaaatcaacccctaaatcctggaaaatgtgcctgtgaatgtacagaaagtccacagaaatgcttgttaaaaggaaagaagttccaccaccaaacatgcagctgttacagacggccatgtacgaaccgccagaaggcttgtgagccaggattttcatatagtgaagaagtgtgtcgttgtgtcccttcatattggaaaagaccacaaatgagctaagattgtactgttttccagttcatcgattttctattatggaaaactgtgttgccacagtagaactgtctgtgaacagagagacccttgtgggtccatgctaacaaagacaaaagtctgtctttcctgaaccatgtggataactttacagaaatggactggagctcatctgcaaaaggcctcttgtaaagactggttttctgccaatgaccaaacagccaagattttcct

SEQ ID NO: 2962 - DNA, 25 bp, Artificial sequence
  Affy probe set ID: 209946_at
cccagaaatcaacccctaaatcctg

SEQ ID NO: 2963 - DNA, 25 bp, Artificial sequence
  Affy probe set ID: 209946_at
ttccaccaccaaacatgcagctgtt

SEQ ID NO: 2964 - DNA, 25 bp, Artificial sequence
  Affy probe set ID: 209946_at
gcagctgttacagacggccatgtac

SEQ ID NO: 2965 - DNA, 25 bp, Artificial sequence
  Affy probe set ID: 209946_at
ggccatgtacgaaccgccagaaggc

SEQ ID NO: 2966 - DNA, 25 bp, Artificial sequence
  Affy probe set ID: 209946_at
agaagtgtgtcgttgtgtcccttca

SEQ ID NO: 2967 - DNA, 25 bp, Artificial sequence
  Affy probe set ID: 209946_at
actgttttccagttcatcgattttc

SEQ ID NO: 2968 - DNA, 25 bp, Artificial sequence
  Affy probe set ID: 209946_at
gagagacccttgtgggtccatgcta

SEQ ID NO: 2969 - DNA, 25 bp, Artificial sequence
  Affy probe set ID: 209946_at
gaaatggactggagctcatctgcaa

SEQ ID NO: 2970 - DNA, 25 bp, Artificial sequence
  Affy probe set ID: 209946_at
gctcatctgcaaaaggcctcttgta

SEQ ID NO: 2971 - DNA, 25 bp, Artificial sequence
  Affy probe set ID: 209946_at
actggttttctgccaatgaccaaac

SEQ ID NO: 2972 - DNA, 25 bp, Artificial sequence
  Affy probe set ID: 209946_at
atgaccaaacagccaagattttcct

SEQ ID NO: 2973 - DNA, 461 bp, Artificial sequence
  Target_Sequence, Fragment of GenBank Accession No. NM_002213
agcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtgagtttcctctcctgtccgtgtttgtttagtac

SEQ ID NO: 2974 - DNA, 25 bp, Artificial sequence
  Affy probe set ID: 201125_s_at
agcccacagtgcctgtacaggaagg

SEQ ID NO: 2975 - DNA, 25 bp, Artificial sequence
  Affy probe set ID: 201125_s_at
aaagcaaggggaccttggcgctctc

SEQ ID NO: 2976 - DNA, 25 bp, Artificial sequence
  Affy probe set ID: 201125_s_at
catccagcttgttgtcccaatgaaa

SEQ ID NO: 2977 - DNA, 25 bp, Artificial sequence
  Affy probe set ID: 201125_s_at
tctcccttccaggaatgctgggccc

SEQ ID NO: 2978 - DNA, 25 bp, Artificial sequence
  Affy probe set ID: 201125_s_at
ggtgtagttctgagtcctgagactt

SEQ ID NO: 2979 - DNA, 25 bp, Artificial sequence
  Affy probe set ID: 201125_s_at
gacttttctgcgtgatggctatgcc

SEQ ID NO: 2980 - DNA, 25 bp, Artificial sequence
  Affy probe set ID: 201125_s_at
gctatgccttgcacacaggtgttgg

SEQ ID NO: 2981 - DNA, 25 bp, Artificial sequence
  Affy probe set ID: 201125_s_at
ggtgttggtgatggggctgttgaga

SEQ ID NO: 2982 - DNA, 25 bp, Artificial sequence
  Affy probe set ID: 201125_s_at
ggggctgttgagatgcctgttgaag

SEQ ID NO: 2983 - DNA, 25 bp, Artificial sequence
  Affy probe set ID: 201125_s_at
gcctgttgaaggtacatcgtttgca

SEQ ID NO: 2984 - DNA, 25 bp, Artificial sequence
  Affy probe set ID: 201125_s_at
tctcctgtccgtgtttgtttagtac

SEQ ID NO: 2985 - DNA, 144 bp, Artificial sequence
  Target_Sequence, Fragment of GenBank Accession No. XM_051017
tcaccgtcacagagtcttaccaaagtcaggacagttcaaataacaatccggagttatgcgtcctcttgaaaaagccgaagacccggcggctctggtcccgcttccccccatggcgacgaacagctggcactgagtagcagctgc

SEQ ID NO: 2986 - DNA, 25 bp, Artificial sequence
  Affy probe set ID: 212775_at
tcaccgtcacagagtcttaccaaag

SEQ ID NO: 2987 - DNA, 25 bp, Artificial sequence
  Affy probe set ID: 212775_at
gtcacagagtcttaccaaagtcagg

SEQ ID NO: 2988 - DNA, 25 bp, Artificial sequence
  Affy probe set ID: 212775_at
caaagtcaggacagttcaaataaca

SEQ ID NO: 2989 - DNA, 25 bp, Artificial sequence
  Affy probe set ID: 212775_at
aacaatccggagttatgcgtcctct

SEQ ID NO: 2990 - DNA, 25 bp, Artificial sequence
  Affy probe set ID: 212775_at
caatccggagttatgcgtcctcttg

SEQ ID NO: 2991 - DNA, 25 bp, Artificial sequence
  Affy probe set ID: 212775_at
tccggagttatgcgtcctcttgaaa

SEQ ID NO: 2992 - DNA, 25 bp, Artificial sequence
  Affy probe set ID: 212775_at
gttatgcgtcctcttgaaaaagccg

SEQ ID NO: 2993 - DNA, 25 bp, Artificial sequence
  Affy probe set ID: 212775_at
gcgtcctcttgaaaaagccgaagac

SEQ ID NO: 2994 - DNA, 25 bp, Artificial sequence
  Affy probe set ID: 212775_at
ccatggcgacgaacagctggcactg

SEQ ID NO: 2995 - DNA, 25 bp, Artificial sequence
  Affy probe set ID: 212775_at
cgaacagctggcactgagtagcagc

SEQ ID NO: 2996 - DNA, 25 bp, Artificial sequence
  Affy probe set ID: 212775_at
acagctggcactgagtagcagctgc

SEQ ID NO: 2997 - DNA, 508 bp, Artificial sequence
  Target_Sequence, Fragment of GenBank Accession No. NM_181724
  misc_feature (430)..(430): n is a, c, g, or t
  misc_feature (462)..(462): n is a, c, g, or t
  misc_feature (480)..(480): n is a, c, g, or t
agggtaaaatcctgcagcacccactctggaaaatactgctcttaattttcctgaaggtggccccctgtttctagttggtccaggattagggatgtggggtatagggcatttaaatcctctcaagcgctctccaagcacccccggcctgggggtgagtttctcatcccgctactgctgctgggatcaggttgaatgaatggaactcttcctgtctggcctccaaagcagcctagaagctgaggggctgtgtttgaggggacctccaccctggggaagtccgaggggctggggaagggtttctgacgcccagcctggagcaggggggccctggccaccccctgttgctcacacattgtctggcagcctgtgtccacaatattcgtcagtcctcgacagggagcctgggctccgtcctgctttagggaggctntggcaggaggtcctctcccccatccctccatntggggctcccccaacctntgcacagctctccaggtgctgagatata

SEQ ID NO: 2998 - DNA, 25 bp, Artificial sequence
  Affy probe set ID: 227300_at
agggtaaaatcctgcagcacccact

SEQ ID NO: 2999 - DNA, 25 bp, Artificial sequence
  Affy probe set ID: 227300_at
aaatactgctcttaattttcctgaa

SEQ ID NO: 3000 - DNA, 25 bp, Artificial sequence
  Affy probe set ID: 227300_at
gctcttaattttcctgaaggtggcc

SEQ ID NO: 3001 - DNA, 25 bp, Artificial sequence
  Affy probe set ID: 227300_at
gtttctagttggtccaggattaggg

SEQ ID NO: 3002 - DNA, 25 bp, Artificial sequence
  Affy probe set ID: 227300_at
ggtccaggattagggatgtggggta

SEQ ID NO: 3003 - DNA, 25 bp, Artificial sequence
  Affy probe set ID: 227300_at
gggtatagggcatttaaatcctctc

SEQ ID NO: 3004 - DNA, 25 bp, Artificial sequence
  Affy probe set ID: 227300_at
agggcatttaaatcctctcaagcgc

SEQ ID NO: 3005 - DNA, 25 bp, Artificial sequence
  Affy probe set ID: 227300_at
gcagcctgtgtccacaatattcgtc

SEQ ID NO: 3006 - DNA, 25 bp, Artificial sequence
  Affy probe set ID: 227300_at
tgtgtccacaatattcgtcagtcct

SEQ ID NO: 3007 - DNA, 25 bp, Artificial sequence
  Affy probe set ID: 227300_at
cacaatattcgtcagtcctcgacag

SEQ ID NO: 3008 - DNA, 25 bp, Artificial sequence
  Affy probe set ID: 227300_at
acagctctccaggtgctgagatata

SEQ ID NO: 3009 - DNA, 435 bp, Artificial sequence
  Target_Sequence, Fragment of GenBank Accession No. NM_003474
  misc_feature (261)..(261): n is a, c, g, or t
  misc_feature (366)..(366): n is a, c, g, or t
gtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacanttcacagcgtggatttttccagcttacacatgtgggatgacatcacagaaaccacaaaagcagcaaattaaactgtaggagagtcaatactcctgacgagtctcnggggggggcatttttatgccttcttaactttatgagaattctcaggctgaactataggccattgttccc

SEQ ID NO: 3010 - DNA, 25 bp, Artificial sequence
  Affy probe set ID: 213790_at
gtttgagttttgtagggccatcacc

SEQ ID NO: 3011 - DNA, 25 bp, Artificial sequence
  Affy probe set ID: 213790_at
gggccatcacctggaaagtcaatgt

SEQ ID NO: 3012 - DNA, 25 bp, Artificial sequence
  Affy probe set ID: 213790_at
ctacttttcttcctacagcttatta

SEQ ID NO: 3013 - DNA, 25 bp, Artificial sequence
  Affy probe set ID: 213790_at
gtaggttctatgacctcacttcatg

SEQ ID NO: 3014 - DNA, 25 bp, Artificial sequence
  Affy probe set ID: 213790_at
cacttcatgggttccaggcaattcc

SEQ ID NO: 3015 - DNA, 25 bp, Artificial sequence
  Affy probe set ID: 213790_at
gcaattccgctgaaaggtttgtctc

SEQ ID NO: 3016 - DNA, 25 bp, Artificial sequence
  Affy probe set ID: 213790_at
gaagcctaacattctccattgtgga

SEQ ID NO: 3017 - DNA, 25 bp, Artificial sequence
  Affy probe set ID: 213790_at
tttttccagcttacacatgtgggat

SEQ ID NO: 3018 - DNA, 25 bp, Artificial sequence
  Affy probe set ID: 213790_at
ggagagtcaatactcctgacgagtc

SEQ ID NO: 3019 - DNA, 25 bp, Artificial sequence
  Affy probe set ID: 213790_at
ggggcatttttatgccttcttaact

SEQ ID NO: 3020 - DNA, 25 bp, Artificial sequence
  Affy probe set ID: 213790_at
ggctgaactataggccattgttccc

SEQ ID NO: 3021 - DNA, 499 bp, Artificial sequence
  Target_Sequence, Fragment of GenBank Accession No. NM_018222
agacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttag

SEQ ID NO: 3022 - DNA, 25 bp, Artificial sequence
  Affy probe set ID: 217890_s_at
agacagagctctagtgtgccagcct

SEQ ID NO: 3023 - DNA, 25 bp, Artificial sequence
  Affy probe set ID: 217890_s_at
gggtgggcagtgactaggggacgag

SEQ ID NO: 3024 - DNA, 25 bp, Artificial sequence
  Affy probe set ID: 217890_s_at
gtggtacttaacacttgtagccatc

SEQ ID NO: 3025 - DNA, 25 bp, Artificial sequence
  Affy probe set ID: 217890_s_at
atcaactgactgagaccttgggcta

SEQ ID NO: 3026 - DNA, 25 bp, Artificial sequence
  Affy probe set ID: 217890_s_at
atatgccaggtagacaccagcccaa

SEQ ID NO: 3027 - DNA, 25 bp, Artificial sequence
  Affy probe set ID: 217890_s_at
gactaccttgtcactactttaggcc

SEQ ID NO: 3028 - DNA, 25 bp, Artificial sequence
  Affy probe set ID: 217890_s_at
tactttaggcccattccacaaagcc

SEQ ID NO: 3029 - DNA, 25 bp, Artificial sequence
  Affy probe set ID: 217890_s_at
ccacaaagcccatctctggtttgag

SEQ ID NO: 3030 - DNA, 25 bp, Artificial sequence
  Affy probe set ID: 217890_s_at
tttgatctgtatctacaccacccaa

SEQ ID NO: 3031 - DNA, 25 bp, Artificial sequence
  Affy probe set ID: 217890_s_at
ttaggcctcctataatgtccaaaac

SEQ ID NO: 3032 - DNA, 25 bp, Artificial sequence
  Affy probe set ID: 217890_s_at
gataactacatgtctttgctcttag

SEQ ID NO: 3033 - DNA, 245 bp, Artificial sequence
  Target_Sequence, Fragment of GenBank Accession No. NM_006478
  misc_feature (34)..(59): n is a, c, g, or t
  misc_feature (177)..(177): n is a, c, g, or t
  misc_feature (179)..(180): n is a, c, g, or t
tcctttgtggccttaacccttctgcatcagggannnnnnnnnnnnnnnnnnnnnnnnnnacctcatgggaccagaccccttgggaccacatggcacaatgggacctctgttgtacattccggttgggggatgagcgttgctatttaattactaatattattgaatgccttagaggangnngggcgagcccggtgttctgaagacctgtggcccagcagagcctctgacagtaaagttttgctcca

SEQ ID NO: 3034 - DNA, 25 bp, Artificial sequence
  Affy probe set ID: 31874_at
tcctttgtggccttaacccttctgc

SEQ ID NO: 3035 - DNA, 25 bp, Artificial sequence
  Affy probe set ID: 31874_at
tttgtggccttaacccttctgcatc

SEQ ID NO: 3036 - DNA, 25 bp, Artificial sequence
  Affy probe set ID: 31874_at
gaccccttgggaccacatggcacaa

SEQ ID NO: 3037 - DNA, 25 bp, Artificial sequence
  Affy probe set ID: 31874_at
gaccacatggcacaatgggacctct

SEQ ID NO: 3038 - DNA, 25 bp, Artificial sequence
  Affy probe set ID: 31874_at
cacatggcacaatgggacctctgtt

SEQ ID NO: 3039 - DNA, 25 bp, Artificial sequence
  Affy probe set ID: 31874_at
tggcacaatgggacctctgttgtac

SEQ ID NO: 3040 - DNA, 25 bp, Artificial sequence
  Affy probe set ID: 31874_at
cacaatgggacctctgttgtacatt

SEQ ID NO: 3041 - DNA, 25 bp, Artificial sequence
  Affy probe set ID: 31874_at
aatgggacctctgttgtacattccg

SEQ ID NO: 3042 - DNA, 25 bp, Artificial sequence
  Affy probe set ID: 31874_at
cccagcagagcctctgacagtaaag

SEQ ID NO: 3043 - DNA, 25 bp, Artificial sequence
  Affy probe set ID: 31874_at
ccagcagagcctctgacagtaaagt

SEQ ID NO: 3044 - DNA, 25 bp, Artificial sequence
  Affy probe set ID: 31874_at
cagcagagcctctgacagtaaagtt

SEQ ID NO: 3045 - DNA, 25 bp, Artificial sequence
  Affy probe set ID: 31874_at
agcagagcctctgacagtaaagttt

SEQ ID NO: 3046 - DNA, 25 bp, Artificial sequence
  Affy probe set ID: 31874_at
gcagagcctctgacagtaaagtttt

SEQ ID NO: 3047 - DNA, 25 bp, Artificial sequence
  Affy probe set ID: 31874_at
agcctctgacagtaaagttttgctc

SEQ ID NO: 3048 - DNA, 25 bp, Artificial sequence
  Affy probe set ID: 31874_at
gcctctgacagtaaagttttgctcc

SEQ ID NO: 3049 - DNA, 25 bp, Artificial sequence
  Affy probe set ID: 31874_at
cctctgacagtaaagttttgctcca

SEQ ID NO: 3050 - DNA, 542 bp, Artificial sequence
  Target_Sequence, Fragment of GenBank Accession No. NM_000093
  misc_feature (56)..(56): n is a, c, g, or t
  misc_feature (63)..(63): n is a, c, g, or t
  misc_feature (102)..(102): n is a, c, g, or t
attgaaaagcaggtaccagtgccccttttcagacagtttttgattcgctctagacnttttttnttttttaatagggagggaaaaaatttgataattttcttntttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctgttttaaggtctccttgaaggcgcactggggtccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacac

SEQ ID NO: 3051 - DNA, 25 bp, Artificial sequence
  Affy probe set ID: 212489_at
attgaaaagcaggtaccagtgcccc

SEQ ID NO: 3052 - DNA, 25 bp, Artificial sequence
  Affy probe set ID: 212489_at
tgccccttttcagacagtttttgat

SEQ ID NO: 3053 - DNA, 25 bp, Artificial sequence
  Affy probe set ID: 212489_at
agacagtttttgattcgctctagac

SEQ ID NO: 3054 - DNA, 25 bp, Artificial sequence
  Affy probe set ID: 212489_at
tttctacatgcacttaagactaaaa

SEQ ID NO: 3055 - DNA, 25 bp, Artificial sequence
  Affy probe set ID: 212489_at
gatgggagaatgtccagggcaggga

SEQ ID NO: 3056 - DNA, 25 bp, Artificial sequence
  Affy probe set ID: 212489_at
ccacagtctgttgccaaggactcta

SEQ ID NO: 3057 - DNA, 25 bp, Artificial sequence
  Affy probe set ID: 212489_at
gttgccaaggactctaagatcaatg

SEQ ID NO: 3058 - DNA, 25 bp, Artificial sequence
  Affy probe set ID: 212489_at
aagatcaatgcacgtcactttcctt

SEQ ID NO: 3059 - DNA, 25 bp, Artificial sequence
  Affy probe set ID: 212489_at
gggctgttatgaggactgggttgtg

SEQ ID NO: 3060 - DNA, 25 bp, Artificial sequence
  Affy probe set ID: 212489_at
ctgggttgtgcctacttgatttgaa

SEQ ID NO: 3061 - DNA, 25 bp, Artificial sequence
  Affy probe set ID: 212489_at
gcctacttgatttgaaaacacacac

SEQ ID NO: 3062 - DNA, 477 bp, Artificial sequence
  Target_Sequence, Fragment of GenBank Accession No. NM_006288
aaagcagcgctagtggagggttggagaaggaggtaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatag

SEQ ID NO: 3063 - DNA, 25 bp, Artificial sequence
  Affy probe set ID: 208851_s_at
aaagcagcgctagtggagggttgga

SEQ ID NO: 3064 - DNA, 25 bp, Artificial sequence
  Affy probe set ID: 208851_s_at
aggatgagggttcatcatccctccc

SEQ ID NO: 3065 - DNA, 25 bp, Artificial sequence
  Affy probe set ID: 208851_s_at
tccctccctgcctaaggaagctaaa

SEQ ID NO: 3066 - DNA, 25 bp, Artificial sequence
  Affy probe set ID: 208851_s_at
aagctaaaagcatggccctgctgcc

SEQ ID NO: 3067 - DNA, 25 bp, Artificial sequence
  Affy probe set ID: 208851_s_at
cacagcctccaagtcaggtggggtg

SEQ ID NO: 3068 - DNA, 25 bp, Artificial sequence
  Affy probe set ID: 208851_s_at
agctgcacagggtttggcccaagtt

SEQ ID NO: 3069 - DNA, 25 bp, Artificial sequence
  Affy probe set ID: 208851_s_at
ggcccaagtttctaagggaggcact

SEQ ID NO: 3070 - DNA, 25 bp, Artificial sequence
  Affy probe set ID: 208851_s_at
ggcctgaggcaagccatggagtgag

SEQ ID NO: 3071 - DNA, 25 bp, Artificial sequence
  Affy probe set ID: 208851_s_at
tggagtgagacccaggagccggaca

SEQ ID NO: 3072 - DNA, 25 bp, Artificial sequence
  Affy probe set ID: 208851_s_at
gagccggacacttctcaggaaatgg

SEQ ID NO: 3073 - DNA, 25 bp, Artificial sequence
  Affy probe set ID: 208851_s_at
cttcctgttctgtgactgtgtatag

SEQ ID NO: 3074 - DNA, 452 bp, Artificial sequence
  Target_Sequence, Fragment of GenBank Accession No. CD357685
  misc_feature (72)..(72): n is a, c, g, or t
  misc_feature (86)..(86): n is a, c, g, or t
  misc_feature (93)..(93): n is a, c, g, or t
  misc_feature (96)..(96): n is a, c, g, or t
  misc_feature (98)..(98): n is a, c, g, or t
  misc_feature (107)..(108): n is a, c, g, or t
  misc_feature (111)..(111): n is a, c, g, or t
  misc_feature (121)..(121): n is a, c, g, or t
  misc_feature (124)..(124): n is a, c, g, or t
  misc_feature (130)..(130): n is a, c, g, or t
  misc_feature (264)..(266): n is a, c, g, or t
  misc_feature (269)..(269): n is a, c, g, or t
  misc_feature (273)..(274): n is a, c, g, or t
  misc_feature (277)..(278): n is a, c, g, or t
  misc_feature (281)..(284): n is a, c, g, or t
  misc_feature (328)..(328): n is a, c, g, or t
  misc_feature (362)..(362): n is a, c, g, or t
  misc_feature (373)..(373): n is a, c, g, or t
  misc_feature (379)..(379): n is a, c, g, or t
gagtaggttcggtctgaaaggtgtgggcctttatatttgatccacacacgttggtcttttaaccgtgctgancagaaaacaaaacnggttaanaananccgggtggnnagntgacagaggnaanccgctnaaataccttcacaataaatagtggcaatatatatatagtttaagaaggctccccatttggcatcgtttaatttaaatgttatgttataagcacagctctcttctccaattttcatcctgcaagcaactcaaaannnttnaaannaannttnnnntgtagttattttcaaatctttgcttgataagtattaagaaatantggacttgctgccgtaatttaaagctctgttgantttgtttccgnttgganttttgggggaggggagcactgtgtttatgctggaatatgaagtctgagaccttccggtgctgggaacacacaa

SEQ ID NO: 3075 - DNA, 25 bp, Artificial sequence
  Affy probe set ID: 231579_s_at
gagtaggttcggtctgaaaggtgtg

SEQ ID NO: 3076 - DNA, 25 bp, Artificial sequence
  Affy probe set ID: 231579_s_at
ggcctttatatttgatccacacacg

SEQ ID NO: 3077 - DNA, 25 bp, Artificial sequence
  Affy probe set ID: 231579_s_at
gatccacacacgttggtcttttaac

SEQ ID NO: 3078 - DNA, 25 bp, Artificial sequence
  Affy probe set ID: 231579_s_at
cacgttggtcttttaaccgtgctga

SEQ ID NO: 3079 - DNA, 25 bp, Artificial sequence
  Affy probe set ID: 231579_s_at
attttcatcctgcaagcaactcaaa

SEQ ID NO: 3080 - DNA, 25 bp, Artificial sequence
  Affy probe set ID: 231579_s_at
attttcaaatctttgcttgataagt

SEQ ID NO: 3081 - DNA, 25 bp, Artificial sequence
  Affy probe set ID: 231579_s_at
tggacttgctgccgtaatttaaagc

SEQ ID NO: 3082 - DNA, 25 bp, Artificial sequence
  Affy probe set ID: 231579_s_at
ctgccgtaatttaaagctctgttga

SEQ ID NO: 3083 - DNA, 25 bp, Artificial sequence
  Affy probe set ID: 231579_s_at
ggagcactgtgtttatgctggaata

SEQ ID NO: 3084 - DNA, 25 bp, Artificial sequence
  Affy probe set ID: 231579_s_at
atgaagtctgagaccttccggtgct

SEQ ID NO: 3085 - DNA, 25 bp, Artificial sequence
  Affy probe set ID: 231579_s_at
accttccggtgctgggaacacacaa

SEQ ID NO: 3086 - DNA, 546 bp, Artificial sequence
  Target_Sequence, Fragment of GenBank Accession No. NM_003247
caggaaatagtcactcatcccactccacataaggggtttagtaagagaagtctgtctgtctgatgatggatagggggcaaatctttttcccctttctgttaatagtcatcacatttctatgccaaacaggaacgatccataactttagtcttaatgtacacattgcattttgataaaattaattttgttgtttcctttgaggttgatcgttgtgttgttttgctgcactttttacttttttgcgtgtggagctgtattcccgagacaacgaagcgttgggatacttcattaaatgtagcgactgtcaacagcgtgcaggttttctgtttctgtgttgtggggtcaaccgtacaatggtgtgggaatgacgatgatgtgaatatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacct

SEQ ID NO: 3087 - DNA, 25 bp, Artificial sequence
  Affy probe set ID: 203083_at
caggaaatagtcactcatcccactc

SEQ ID NO: 3088 - DNA, 25 bp, Artificial sequence
  Affy probe set ID: 203083_at
actcatcccactccacataaggggt

SEQ ID NO: 3089 - DNA, 25 bp, Artificial sequence
  Affy probe set ID: 203083_at
tttcccctttctgttaatagtcatc

SEQ ID NO: 3090 - DNA, 25 bp, Artificial sequence
  Affy probe set ID: 203083_at
atagtcatcacatttctatgccaaa

SEQ ID NO: 3091 - DNA, 25 bp, Artificial sequence
  Affy probe set ID: 203083_at
ggaacgatccataactttagtctta

SEQ ID NO: 3092 - DNA, 25 bp, Artificial sequence
  Affy probe set ID: 203083_at
cgttgtgttgttttgctgcactttt

SEQ ID NO: 3093 - DNA, 25 bp, Artificial sequence
  Affy probe set ID: 203083_at
ttgcgtgtggagctgtattcccgag

SEQ ID NO: 3094 - DNA, 25 bp, Artificial sequence
  Affy probe set ID: 203083_at
gtattcccgagacaacgaagcgttg

SEQ ID NO: 3095 - DNA, 25 bp, Artificial sequence
  Affy probe set ID: 203083_at
gtagcgactgtcaacagcgtgcagg

SEQ ID NO: 3096 - DNA, 25 bp, Artificial sequence
  Affy probe set ID: 203083_at
gtgttgtggggtcaaccgtacaatg

SEQ ID NO: 3097 - DNA, 25 bp, Artificial sequence
  Affy probe set ID: 203083_at
gaaaccctgcacttagctagaacct

SEQ ID NO: 3098 - DNA, 93 bp, Artificial sequence
  Target_Sequence, Fragment of GenBank Accession No. NM_000088
tgggagacaatttcacatggactttggaaaatatttttttcctttgcattcatctctcaaacttagtttttatctttgaccaaccgaacatga

SEQ ID NO: 3099 - DNA, 25 bp, Artificial sequence
  Affy probe set ID: 1556499_s_at
tgggagacaatttcacatggacttt

SEQ ID NO: 3100 - DNA, 25 bp, Artificial sequence
  Affy probe set ID: 1556499_s_at
gagacaatttcacatggactttgga

SEQ ID NO: 3101 - DNA, 25 bp, Artificial sequence
  Affy probe set ID: 1556499_s_at
acaatttcacatggactttggaaaa

SEQ ID NO: 3102 - DNA, 25 bp, Artificial sequence
  Affy probe set ID: 1556499_s_at
ttcctttgcattcatctctcaaact

SEQ ID NO: 3103 - DNA, 25 bp, Artificial sequence
  Affy probe set ID: 1556499_s_at
tcctttgcattcatctctcaaactt

SEQ ID NO: 3104 - DNA, 25 bp, Artificial sequence
  Affy probe set ID: 1556499_s_at
tttgcattcatctctcaaacttagt

SEQ ID NO: 3105 - DNA, 25 bp, Artificial sequence
  Affy probe set ID: 1556499_s_at
tgcattcatctctcaaacttagttt

SEQ ID NO: 3106 - DNA, 25 bp, Artificial sequence
  Affy probe set ID: 1556499_s_at
cattcatctctcaaacttagttttt

SEQ ID NO: 3107 - DNA, 25 bp, Artificial sequence
  Affy probe set ID: 1556499_s_at
atctctcaaacttagtttttatctt

SEQ ID NO: 3108 - DNA, 25 bp, Artificial sequence
  Affy probe set ID: 1556499_s_at
tttttatctttgaccaaccgaacat

SEQ ID NO: 3109 - DNA, 25 bp, Artificial sequence
  Affy probe set ID: 1556499_s_at
tttatctttgaccaaccgaacatga

SEQ ID NO: 3110 - DNA, 536 bp, Artificial sequence
  Target_Sequence, Fragment of GenBank Accession No. NM_006832
  misc_feature (26)..(26): n is a, c, g, or t
  misc_feature (64)..(64): n is a, c, g, or t
  misc_feature (124)..(124): n is a, c, g, or t
aaaatgctattagtccgtcgtgcttnatttgtttttgtccttgaataagcatgttatgtatatngtctcgtgtttttatttttacaccatattgtattacacttttagtattcaccagcataancactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttca

SEQ ID NO: 3111 - DNA, 25 bp, Artificial sequence
  Affy probe set ID: 209210_s_at
aaaatgctattagtccgtcgtgctt

SEQ ID NO: 3112 - DNA, 25 bp, Artificial sequence
  Affy probe set ID: 209210_s_at
acacttttagtattcaccagcataa

SEQ ID NO: 3113 - DNA, 25 bp, Artificial sequence
  Affy probe set ID: 209210_s_at
actactcacaactagcagatggctt

SEQ ID NO: 3114 - DNA, 25 bp, Artificial sequence
  Affy probe set ID: 209210_s_at
gcaatctctgcgttaattaaatgcc

SEQ ID NO: 3115 - DNA, 25 bp, Artificial sequence
  Affy probe set ID: 209210_s_at
tgatttgccacaatgtccttaactc

SEQ ID NO: 3116 - DNA, 25 bp, Artificial sequence
  Affy probe set ID: 209210_s_at
ccttaactctaatgcctggactggc

SEQ ID NO: 3117 - DNA, 25 bp, Artificial sequence
  Affy probe set ID: 209210_s_at
tgcctggactggccatgttctagtc

SEQ ID NO: 3118 - DNA, 25 bp, Artificial sequence
  Affy probe set ID: 209210_s_at
tgttctagtctgttgcgctgttaca

SEQ ID NO: 3119 - DNA, 25 bp, Artificial sequence
  Affy probe set ID: 209210_s_at
gcgctgttacaatctgtattggtgc

SEQ ID NO: 3120 - DNA, 25 bp, Artificial sequence
  Affy probe set ID: 209210_s_at
aaaattcctagctcacatagcccaa

SEQ ID NO: 3121 - DNA, 25 bp, Artificial sequence
  Affy probe set ID: 209210_s_at
gtattgttcaataatccatggttca

SEQ ID NO: 3122 - DNA, 345 bp, Artificial sequence
  Target_Sequence, Fragment of GenBank Accession No. NM_021961
taaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggta

SEQ ID NO: 3123 - DNA, 25 bp, Artificial sequence
  Affy probe set ID: 224955_at
taaatcggttttcgccacgtgtgtt

SEQ ID NO: 3124 - DNA, 25 bp, Artificial sequence
  Affy probe set ID: 224955_at
gccacgtgtgtttgttcacattcta

SEQ ID NO: 3125 - DNA, 25 bp, Artificial sequence
  Affy probe set ID: 224955_at
aatgggattctcacggtctgtgtct

SEQ ID NO: 3126 - DNA, 25 bp, Artificial sequence
  Affy probe set ID: 224955_at
gtaagcgtttcatctggtcagtggt

SEQ ID NO: 3127 - DNA, 25 bp, Artificial sequence
  Affy probe set ID: 224955_at
gttcctttgatattgtactgctgct

SEQ ID NO: 3128 - DNA, 25 bp, Artificial sequence
  Affy probe set ID: 224955_at
gtaactgggttcctcttgggtagat

SEQ ID NO: 3129 - DNA, 25 bp, Artificial sequence
  Affy probe set ID: 224955_at
ggtgggcgtgggcaaattctcacac

SEQ ID NO: 3130 - DNA, 25 bp, Artificial sequence
  Affy probe set ID: 224955_at
ttctcacacatgttttcttaaccta

SEQ ID NO: 3131 - DNA, 25 bp, Artificial sequence
  Affy probe set ID: 224955_at
aaacctcttggcagtacagtattct

SEQ ID NO: 3132 - DNA, 25 bp, Artificial sequence
  Affy probe set ID: 224955_at
gtattcttgtatttgttaacgtctg

SEQ ID NO: 3133 - DNA, 25 bp, Artificial sequence
  Affy probe set ID: 224955_at
taacgtctgtgtttaggtactggta

SEQ ID NO: 3134 - DNA, 508 bp, Artificial sequence
  Target_Sequence, Fragment of GenBank Accession No. AK128814
  misc_feature (39)..(39): n is a, c, g, or t
  misc_feature (67)..(67): n is a, c, g, or t
  misc_feature (111)..(111): n is a, c, g, or t
ttaccgcctgcctggagaaacacagtgcctgcccttggnaaatatatgttggtgtatctgaaaaacnagctcctggaagctttttctcattcaggctttaggggttacccnatctttccttatgtgtgtaatattggagaatgtacactctcactgaactggggatgtttgacttaaaatgatggacaataagatagtgagcagtaagtgtgctctaggctaggctacgagaggccatgagctcctcatctcttctctgttctgagctctctgatccactgcacttggggcagggggtgcattctctgtgcctctcctgagtctactttctgcatcattggttctcccagctcacttccataatgtcctcctaggctgcattggaattgtgtgttgtctagacccatggccaagactgtcattgcctgtgagggagaccaagctcaccaccaagggcttttgccagattgctttcatttacagaatttgcccattcatgtgtctttgt

SEQ ID NO: 3135 - DNA, 25 bp, Artificial sequence
  Affy probe set ID: 213675_at
ttaccgcctgcctggagaaacacag

SEQ ID NO: 3136 - DNA, 25 bp, Artificial sequence
  Affy probe set ID: 213675_at
ctcctggaagctttttctcattcag

SEQ ID NO: 3137 - DNA, 25 bp, Artificial sequence
  Affy probe set ID: 213675_at
gtacactctcactgaactggggatg

SEQ ID NO: 3138 - DNA, 25 bp, Artificial sequence
  Affy probe set ID: 213675_at
aagtgtgctctaggctaggctacga

SEQ ID NO: 3139 - DNA, 25 bp, Artificial sequence
  Affy probe set ID: 213675_at
aggctacgagaggccatgagctcct

SEQ ID NO: 3140 - DNA, 25 bp, Artificial sequence
  Affy probe set ID: 213675_at
ctctgatccactgcacttggggcag

SEQ ID NO: 3141 - DNA, 25 bp, Artificial sequence
  Affy probe set ID: 213675_at
gtctactttctgcatcattggttct

SEQ ID NO: 3142 - DNA, 25 bp, Artificial sequence
  Affy probe set ID: 213675_at
ggaattgtgtgttgtctagacccat

SEQ ID NO: 3143 - DNA, 25 bp, Artificial sequence
  Affy probe set ID: 213675_at
tagacccatggccaagactgtcatt

SEQ ID NO: 3144 - DNA, 25 bp, Artificial sequence
  Affy probe set ID: 213675_at
ctcaccaccaagggcttttgccaga

SEQ ID NO: 3145 - DNA, 25 bp, Artificial sequence
  Affy probe set ID: 213675_at
aatttgcccattcatgtgtctttgt

SEQ ID NO: 3146 - DNA, 504 bp, Artificial sequence
  Target_Sequence, Fragment of GenBank Accession No. NM_153367
caccccaaagtgaccttgccagtgagctgttcagcaggtagccactgccctgccatctgtgcagagccagccaccttgggggctggggttcccgctttgaggcccaccttccatactccccttgactcggctctggctgaactggggaactctcttgtggtcagcaaagcccctgccatgcaggccaggtgccattgagaattaagtgctcagagggccaggagcccaggggatgggaaagtgtgtggttttagtacgttcaaaagggacaatcgcttgcagttggtagatctagcgatctagttgggagataatggtgtttaccccatatgaagtattcaatagttctacttgtgaatttgtatttattttgagttatacttgacacagaattccttttttaaaaaaatatgtgtgtattttggaaaaaaaattcatagatgttaaaatttctgcatggttaccagtttttctcacaacactgaatttggtagcttttcccga

SEQ ID NO: 3147 - DNA, 25 bp, Artificial sequence
  Affy probe set ID: 212423_at
caccccaaagtgaccttgccagtga

SEQ ID NO: 3148 - DNA, 25 bp, Artificial sequence
  Affy probe set ID: 212423_at
tgagctgttcagcaggtagccactg

SEQ ID NO: 3149 - DNA, 25 bp, Artificial sequence
  Affy probe set ID: 212423_at
actggggaactctcttgtggtcagc

SEQ ID NO: 3150 - DNA, 25 bp, Artificial sequence
  Affy probe set ID: 212423_at
aactctcttgtggtcagcaaagccc

SEQ ID NO: 3151 - DNA, 25 bp, Artificial sequence
  Affy probe set ID: 212423_at
gcaggccaggtgccattgagaatta

SEQ ID NO: 3152 - DNA, 25 bp, Artificial sequence
  Affy probe set ID: 212423_at
gaattaagtgctcagagggccagga

SEQ ID NO: 3153 - DNA, 25 bp, Artificial sequence
  Affy probe set ID: 212423_at
gggacaatcgcttgcagttggtaga

SEQ ID NO: 3154 - DNA, 25 bp, Artificial sequence
  Affy probe set ID: 212423_at
ggtgtttaccccatatgaagtattc

SEQ ID NO: 3155 - DNA, 25 bp, Artificial sequence
  Affy probe set ID: 212423_at
atacttgacacagaattcctttttt

SEQ ID NO: 3156 - DNA, 25 bp, Artificial sequence
  Affy probe set ID: 212423_at
gcatggttaccagtttttctcacaa

SEQ ID NO: 3157 - DNA, 25 bp, Artificial sequence
  Affy probe set ID: 212423_at
cactgaatttggtagcttttcccga

SEQ ID NO: 3158 - DNA, 390 bp, Artificial sequence
  Target_Sequence, Fragment of GenBank Accession No. AK092048
  misc_feature (96)..(96): n is a, c, g, or t
attgtttcccatagcagaatgtcaatattcacagtacatttctgtaaagagcaaaccaatataatgttttgagtgttgaaaaaaattccagatttntgaagaattagacaactcttcatctaccttatttctagttcacacagttatctcaaattccactgaaactaatgggatactgtcttgtgtagatgccagttgagtttataatgtgacctagtaaagctgtcttttttgttgtgttgtatgagtgtcggatcatgcttttaggaatacttttattaaaatggtgtgcattcatgcaaaaggccaactggcttttgtgaacaatagatcttttctcccctttattttgttctcttgacacttttgtgaaaattacctagcctgata

SEQ ID NO: 3159 - DNA, 25 bp, Artificial sequence
  Affy probe set ID: 227623_at
attgtttcccatagcagaatgtcaa

SEQ ID NO: 3160 - DNA, 25 bp, Artificial sequence
  Affy probe set ID: 227623_at
agacaactcttcatctaccttattt

SEQ ID NO: 3161 - DNA, 25 bp, Artificial sequence
  Affy probe set ID: 227623_at
atttctagttcacacagttatctca

SEQ ID NO: 3162 - DNA, 25 bp, Artificial sequence
  Affy probe set ID: 227623_at
gttatctcaaattccactgaaacta

SEQ ID NO: 3163 - DNA, 25 bp, Artificial sequence
  Affy probe set ID: 227623_at
gaaactaatgggatactgtcttgtg

SEQ ID NO: 3164 - DNA, 25 bp, Artificial sequence
  Affy probe set ID: 227623_at
gtcttgtgtagatgccagttgagtt

SEQ ID NO: 3165 - DNA, 25 bp, Artificial sequence
  Affy probe set ID: 227623_at
gtgacctagtaaagctgtctttttt

SEQ ID NO: 3166 - DNA, 25 bp, Artificial sequence
  Affy probe set ID: 227623_at
gagtgtcggatcatgcttttaggaa

SEQ ID NO: 3167 - DNA, 25 bp, Artificial sequence
  Affy probe set ID: 227623_at
tgaacaatagatcttttctcccctt

SEQ ID NO: 3168 - DNA, 25 bp, Artificial sequence
  Affy probe set ID: 227623_at
tattttgttctcttgacacttttgt

SEQ ID NO: 3169 - DNA, 25 bp, Artificial sequence
  Affy probe set ID: 227623_at
tttgtgaaaattacctagcctgata

SEQ ID NO: 3170 - DNA, 505 bp, Artificial sequence
  Target_Sequence, Fragment of GenBank Accession No. NM_005245
tgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagt

SEQ ID NO: 3171 - DNA, 25 bp, Artificial sequence
  Affy probe set ID: 201579_at
tgccatttcccaacgtcttttggga

SEQ ID NO: 3172 - DNA, 25 bp, Artificial sequence
  Affy probe set ID: 201579_at
gtcttttgggatttacatctgtctg

SEQ ID NO: 3173 - DNA, 25 bp, Artificial sequence
  Affy probe set ID: 201579_at
aaatcagtcctgtgttgtcagcatg

SEQ ID NO: 3174 - DNA, 25 bp, Artificial sequence
  Affy probe set ID: 201579_at
gtcagtgccattatctagcaccctg

SEQ ID NO: 3175 - DNA, 25 bp, Artificial sequence
  Affy probe set ID: 201579_at
taaccagggtttcattctgtctttt

SEQ ID NO: 3176 - DNA, 25 bp, Artificial sequence
  Affy probe set ID: 201579_at
gtagtcattcatttctagctgtaca

SEQ ID NO: 3177 - DNA, 25 bp, Artificial sequence
  Affy probe set ID: 201579_at
gaacatgtcttacatgggttgctgt

SEQ ID NO: 3178 - DNA, 25 bp, Artificial sequence
  Affy probe set ID: 201579_at
gaaagtgtaacggggaccttctgca

SEQ ID NO: 3179 - DNA, 25 bp, Artificial sequence
  Affy probe set ID: 201579_at
ggaccttctgcatacctgtttagaa

SEQ ID NO: 3180 - DNA, 25 bp, Artificial sequence
  Affy probe set ID: 201579_at
tttagaaccaaaaccaccatgacac

SEQ ID NO: 3181 - DNA, 25 bp, Artificial sequence
  Affy probe set ID: 201579_at
accaccatgacacagtttttatagt

SEQ ID NO: 3182 - DNA, 537 bp, Artificial sequence
  Target_Sequence, Fragment of GenBank Accession No. NM_001129
ccaccgctggctgggaggagtcggagactgagacctacacagaggtggtgacagagtttgggaccgaggtggagcccgagtttgggaccaaggtggagcccgagtttgagacccagttggagcctgagttcgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactcca

SEQ ID NO: 3183 - DNA, 25 bp, Artificial sequence
  Affy probe set ID: 201792_at
ccaccgctggctgggaggagtcgga

SEQ ID NO: 3184 - DNA, 25 bp, Artificial sequence
  Affy probe set ID: 201792_at
gaggtggagcccgagtttgggacca

SEQ ID NO: 3185 - DNA, 25 bp, Artificial sequence
  Affy probe set ID: 201792_at
gaccaaggtggagcccgagtttgag

SEQ ID NO: 3186 - DNA, 25 bp, Artificial sequence
  Affy probe set ID: 201792_at
gagacccagttggagcctgagttcg

SEQ ID NO: 3187 - DNA, 25 bp, Artificial sequence
  Affy probe set ID: 201792_at
cccagctggaacccgagtttgagga

SEQ ID NO: 3188 - DNA, 25 bp, Artificial sequence
  Affy probe set ID: 201792_at
ggagatagccactggccaggcattc

SEQ ID NO: 3189 - DNA, 25 bp, Artificial sequence
  Affy probe set ID: 201792_at
ttctgagatcagcgtcctaccaaga

SEQ ID NO: 3190 - DNA, 25 bp, Artificial sequence
  Affy probe set ID: 201792_at
tcagcacatggaaggcccctggtat

SEQ ID NO: 3191 - DNA, 25 bp, Artificial sequence
  Affy probe set ID: 201792_at
gtcctgcccctttgagggggtgcaa

SEQ ID NO: 3192 - DNA, 25 bp, Artificial sequence
  Affy probe set ID: 201792_at
gccagaggctgtgtagaggctcctg

SEQ ID NO: 3193 - DNA, 25 bp, Artificial sequence
  Affy probe set ID: 201792_at
gagggagggagccaaggtcactcca

SEQ ID NO: 3194 - DNA, 534 bp, Artificial sequence
  Target_Sequence, Fragment of GenBank Accession No. NM_002403
ctccgccgtgtgtacgtcattaacaaggagatctgtgttcgtacagtgtgtgcccacgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggctacctgacctggtgcttttttccccatccccatgttccttttattctgaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcctgacgggcccttctcagcccgttttgaggacagacagtcccccgaggtaggctacatccccccaccccagctggtctgcttggatttcctacagcc

SEQ ID NO: 3195 - DNA, 25 bp, Artificial sequence
  Affy probe set ID: 203417_at
ctccgccgtgtgtacgtcattaaca

SEQ ID NO: 3196 - DNA, 25 bp, Artificial sequence
  Affy probe set ID: 203417_at
taacaaggagatctgtgttcgtaca

SEQ ID NO: 3197 - DNA, 25 bp, Artificial sequence
  Affy probe set ID: 203417_at
ctgtgttcgtacagtgtgtgcccac

SEQ ID NO: 3198 - DNA, 25 bp, Artificial sequence
  Affy probe set ID: 203417_at
tcgtacagtgtgtgcccacgaggag

SEQ ID NO: 3199 - DNA, 25 bp, Artificial sequence
  Affy probe set ID: 203417_at
agctgacctctgtcgggacaagttc

SEQ ID NO: 3200 - DNA, 25 bp, Artificial sequence
  Affy probe set ID: 203417_at
gacctctgtcgggacaagttctcca

SEQ ID NO: 3201 - DNA, 25 bp, Artificial sequence
  Affy probe set ID: 203417_at
gacaagttctccaaatgtggcgtga

SEQ ID NO: 3202 - DNA, 25 bp, Artificial sequence
  Affy probe set ID: 203417_at
tgtggcgtgatggccagcagcggcc

SEQ ID NO: 3203 - DNA, 25 bp, Artificial sequence
  Affy probe set ID: 203417_at
gctgtgggagctgctagggtggtgc

SEQ ID NO: 3204 - DNA, 25 bp, Artificial sequence
  Affy probe set ID: 203417_at
tttgaggacagacagtcccccgagg

SEQ ID NO: 3205 - DNA, 25 bp, Artificial sequence
  Affy probe set ID: 203417_at
tggtctgcttggatttcctacagcc

SEQ ID NO: 3206 - DNA, 445 bp, Artificial sequence
  Target_Sequence, Fragment of GenBank Accession No. NM_004342
cttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaa

SEQ ID NO: 3207 - DNA, 25 bp, Artificial sequence
  Affy probe set ID: 201616_s_at
cttgagaccaggagacgtatccagc

SEQ ID NO: 3208 - DNA, 25 bp, Artificial sequence
  Affy probe set ID: 201616_s_at
gacgtatccagcaagcggaacctct

SEQ ID NO: 3209 - DNA, 25 bp, Artificial sequence
  Affy probe set ID: 201616_s_at
gcaagcggaacctctgggaaaagca

SEQ ID NO: 3210 - DNA, 25 bp, Artificial sequence
  Affy probe set ID: 201616_s_at
tctgtggataaggtcacttccccca

SEQ ID NO: 3211 - DNA, 25 bp, Artificial sequence
  Affy probe set ID: 201616_s_at
cttcccccactaaggtttgagacag

SEQ ID NO: 3212 - DNA, 25 bp, Artificial sequence
  Affy probe set ID: 201616_s_at
gaacccaagctcaagacgcaggacg

SEQ ID NO: 3213 - DNA, 25 bp, Artificial sequence
  Affy probe set ID: 201616_s_at
gacgcaggacgagctcagttgtaga

SEQ ID NO: 3214 - DNA, 25 bp, Artificial sequence
  Affy probe set ID: 201616_s_at
ttcaatatcccagtaaacccatgta

SEQ ID NO: 3215 - DNA, 25 bp, Artificial sequence
  Affy probe set ID: 201616_s_at
actgatcatcataactctgtatctg

SEQ ID NO: 3216 - DNA, 25 bp, Artificial sequence
  Affy probe set ID: 201616_s_at
agcagtgataccaaccacatctgaa

SEQ ID NO: 3217 - DNA, 25 bp, Artificial sequence
  Affy probe set ID: 201616_s_at
gcggaatgtgtgcagtatctagaaa

SEQ ID NO: 3218 - DNA, 549 bp, Artificial sequence
  Target_Sequence, Fragment of GenBank Accession No. NM_005576
ctggaggacagcacctgtgacttcggcaacctcaagcgctatgcatgcacctctcatacccagggcctgagcccaggctgctatgacacctacaatgcggacatcgactgccagtggatcgacataaccgacgtgcagcctgggaactacatcctcaaggtgcacgtgaacccaaagtatattgttttggagtctgacttcaccaacaacgtggtgagatgcaacattcactacacaggtcgctacgtttctgcaacaaactgcaaaattgtccaatcctgatctccgggagggacagatggccaatctctccccttccaaagcaggccctgctccccgggcagcctcccgccgaggggcccagcccccaacccacaggcagggaggggcatccctccctgccggcctcagggagcgaacgtggatgaaaaccacagggattccggatgccagaccccattttatacttcacttttctctacagtgttgttttgttgttgttggtttttattttttatactttggccataccacagagctagattgccc

SEQ ID NO: 3219 - DNA, 25 bp, Artificial sequence
  Affy probe set ID: 203570_at
ctggaggacagcacctgtgacttcg

SEQ ID NO: 3220 - DNA, 25 bp, Artificial sequence
  Affy probe set ID: 203570_at
gcaacctcaagcgctatgcatgcac

SEQ ID NO: 3221 - DNA, 25 bp, Artificial sequence
  Affy probe set ID: 203570_at
ggctgctatgacacctacaatgcgg

SEQ ID NO: 3222 - DNA, 25 bp, Artificial sequence
  Affy probe set ID: 203570_at
ctacaatgcggacatcgactgccag

SEQ ID NO: 3223 - DNA, 25 bp, Artificial sequence
  Affy probe set ID: 203570_at
ggatcgacataaccgacgtgcagcc

SEQ ID NO: 3224 - DNA, 25 bp, Artificial sequence
  Affy probe set ID: 203570_at
cagcctgggaactacatcctcaagg

SEQ ID NO: 3225 - DNA, 25 bp, Artificial sequence
  Affy probe set ID: 203570_at
gagatgcaacattcactacacaggt

SEQ ID NO: 3226 - DNA, 25 bp, Artificial sequence
  Affy probe set ID: 203570_at
actacacaggtcgctacgtttctgc

SEQ ID NO: 3227 - DNA, 25 bp, Artificial sequence
  Affy probe set ID: 203570_at
tccaatcctgatctccgggagggac

SEQ ID NO: 3228 - DNA, 25 bp, Artificial sequence
  Affy probe set ID: 203570_at
gagggacagatggccaatctctccc

SEQ ID NO: 3229 - DNA, 25 bp, Artificial sequence
  Affy probe set ID: 203570_at
gccataccacagagctagattgccc

SEQ ID NO: 3230 - DNA, 512 bp, Artificial sequence
  Target_Sequence, Fragment of GenBank Accession No. NM_199511
  misc_feature (447)..(448): n is a, c, g, or t
  misc_feature (450)..(455): n is a, c, g, or t
ggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagnnannnnnnaccttagactcagccagtttcctctgcagctgctaaaactacatgtggccagctcca

SEQ ID NO: 3231 - DNA, 25 bp, Artificial sequence
  Affy probe set ID: 225242_s_at
ggcgtgcaattttggtctgcgccac

SEQ ID NO: 3232 - DNA, 25 bp, Artificial sequence
  Affy probe set ID: 225242_s_at
tgcgccacataaccattctgaagct

SEQ ID NO: 3233 - DNA, 25 bp, Artificial sequence
  Affy probe set ID: 225242_s_at
tgagcgagaagacgtaccagcccat

SEQ ID NO: 3234 - DNA, 25 bp, Artificial sequence
  Affy probe set ID: 225242_s_at
caagtgagcccggagtacttctcca

SEQ ID NO: 3235 - DNA, 25 bp, Artificial sequence
  Affy probe set ID: 225242_s_at
tacttctccatgcttctagtcggaa

SEQ ID NO: 3236 - DNA, 25 bp, Artificial sequence
  Affy probe set ID: 225242_s_at
gtggtccatggtgattgtgtacgat

SEQ ID NO: 3237 - DNA, 25 bp, Artificial sequence
  Affy probe set ID: 225242_s_at
cagcagtcactggggatgcgctgcc

SEQ ID NO: 3238 - DNA, 25 bp, Artificial sequence
  Affy probe set ID: 225242_s_at
tgcgctgcccagaagatgagtatgc

SEQ ID NO: 3239 - DNA, 25 bp, Artificial sequence
  Affy probe set ID: 225242_s_at
gttaccatagttaccaccaaggata

SEQ ID NO: 3240 - DNA, 25 bp, Artificial sequence
  Affy probe set ID: 225242_s_at
gagagttatcaccatggataccctt

SEQ ID NO: 3241 - DNA, 25 bp, Artificial sequence
  Affy probe set ID: 225242_s_at
ctaaaactacatgtggccagctcca

SEQ ID NO: 3242 - DNA, 373 bp, Artificial sequence
  Target_Sequence, Fragment of GenBank Accession No. NM_012098
gcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagt

SEQ ID NO: 3243 - DNA, 25 bp, Artificial sequence
  Affy probe set ID: 213001_at
gcccccagatggctacagaccagag

SEQ ID NO: 3244 - DNA, 25 bp, Artificial sequence
  Affy probe set ID: 213001_at
tacagaccagagattccacgctctc

SEQ ID NO: 3245 - DNA, 25 bp, Artificial sequence
  Affy probe set ID: 213001_at
cgctctcaggctgactagagtccgc

SEQ ID NO: 3246 - DNA, 25 bp, Artificial sequence
  Affy probe set ID: 213001_at
atctccaaactacacttccctggag

SEQ ID NO: 3247 - DNA, 25 bp, Artificial sequence
  Affy probe set ID: 213001_at
aaacaggccacttctcaggagttga

SEQ ID NO: 3248 - DNA, 25 bp, Artificial sequence
  Affy probe set ID: 213001_at
cagcatggtggctttctgagtcctg

SEQ ID NO: 3249 - DNA, 25 bp, Artificial sequence
  Affy probe set ID: 213001_at
cactcccgggactattgccaagaag

SEQ ID NO: 3250 - DNA, 25 bp, Artificial sequence
  Affy probe set ID: 213001_at
caagaaggtgagacccttcccggtg

SEQ ID NO: 3251 - DNA, 25 bp, Artificial sequence
  Affy probe set ID: 213001_at
gtttggtactgtccatgtctgggtg

SEQ ID NO: 3252 - DNA, 25 bp, Artificial sequence
  Affy probe set ID: 213001_at
tctgggtgtgtgcctattacctcag

SEQ ID NO: 3253 - DNA, 25 bp, Artificial sequence
  Affy probe set ID: 213001_at
attacctcagcatttctcacaaagt

SEQ ID NO: 3254 - DNA, 440 bp, Artificial sequence
  Target_Sequence, Fragment of GenBank Accession No. NM_002210
ggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaa

SEQ ID NO: 3255 - DNA, 25 bp, Artificial sequence
  Affy probe set ID: 202351_at
ggagaggtactgaatctttgatgtt

SEQ ID NO: 3256 - DNA, 25 bp, Artificial sequence
  Affy probe set ID: 202351_at
gtcattgttctcaagtgcaatataa

SEQ ID NO: 3257 - DNA, 25 bp, Artificial sequence
  Affy probe set ID: 202351_at
agttgtcattaatttagtaagccta

SEQ ID NO: 3258 - DNA, 25 bp, Artificial sequence
  Affy probe set ID: 202351_at
atttacccctaaatggtccattctg

SEQ ID NO: 3259 - DNA, 25 bp, Artificial sequence
  Affy probe set ID: 202351_at
gtccattctgcattgtatttcaggc

SEQ ID NO: 3260 - DNA, 25 bp, Artificial sequence
  Affy probe set ID: 202351_at
atgaattattctttaccagttttga

SEQ ID NO: 3261 - DNA, 25 bp, Artificial sequence
  Affy probe set ID: 202351_at
ggtaacttggaagctgtgtagtata

SEQ ID NO: 3262 - DNA, 25 bp, Artificial sequence
  Affy probe set ID: 202351_at
agtaaatatctttgtggtcacccac

SEQ ID NO: 3263 - DNA, 25 bp, Artificial sequence
  Affy probe set ID: 202351_at
atctttgtggtcacccacattgggt

SEQ ID NO: 3264 - DNA, 25 bp, Artificial sequence
  Affy probe set ID: 202351_at
aaactggtacagtgttctgcttgat

SEQ ID NO: 3265 - DNA, 25 bp, Artificial sequence
  Affy probe set ID: 202351_at
gttctgcttgatttacaacatgtaa

SEQ ID NO: 3266 - DNA, 138 bp, Artificial sequence
  Target_Sequence, Fragment of GenBank Accession No. NM_000366
attcctttctgattggcacacgtgcagctcatgacaatctgtaggataacaatcagtgtggatttccactcttttcagtccttcatgttaaagatttagacaccacatacaactggtaaaggacgttttcttgagagt

SEQ ID NO: 3267 - DNA, 25 bp, Artificial sequence
  Affy probe set ID: 210986_s_at
attcctttctgattggcacacgtgc

SEQ ID NO: 3268 - DNA, 25 bp, Artificial sequence
  Affy probe set ID: 210986_s_at
cctttctgattggcacacgtgcagc

SEQ ID NO: 3269 - DNA, 25 bp, Artificial sequence
  Affy probe set ID: 210986_s_at
ttggcacacgtgcagctcatgacaa

SEQ ID NO: 3270 - DNA, 25 bp, Artificial sequence
  Affy probe set ID: 210986_s_at
gcagctcatgacaatctgtaggata

SEQ ID NO: 3271 - DNA, 25 bp, Artificial sequence
  Affy probe set ID: 210986_s_at
atctgtaggataacaatcagtgtgg

SEQ ID NO: 3272 - DNA, 25 bp, Artificial sequence
  Affy probe set ID: 210986_s_at
agtgtggatttccactcttttcagt

SEQ ID NO: 3273 - DNA, 25 bp, Artificial sequence
  Affy probe set ID: 210986_s_at
actcttttcagtccttcatgttaaa

SEQ ID NO: 3274 - DNA, 25 bp, Artificial sequence
  Affy probe set ID: 210986_s_at
ttcagtccttcatgttaaagattta

SEQ ID NO: 3275 - DNA, 25 bp, Artificial sequence
  Affy probe set ID: 210986_s_at
aagatttagacaccacatacaactg

SEQ ID NO: 3276 - DNA, 25 bp, Artificial sequence
  Affy probe set ID: 210986_s_at
gacaccacatacaactggtaaagga

SEQ ID NO: 3277 - DNA, 25 bp, Artificial sequence
  Affy probe set ID: 210986_s_at
tggtaaaggacgttttcttgagagt

SEQ ID NO: 3278 - DNA, 414 bp, Artificial sequence
  Target_Sequence, Fragment of GenBank Accession No. NM_198474
  misc_feature (59)..(59): n is a, c, g, or t
  misc_feature (61)..(69): n is a, c, g, or t
  misc_feature (71)..(71): n is a, c, g, or t
  misc_feature (240)..(240): n is a, c, g, or t
ctgtccttccactaagcttggtagatgtaataataaagtgaaaatattaacatttgaanannnnnnnnnangtgtggagtgtttgcacatcatttaattctcgtttcacctttgtgaaacatgcacaagtctttacagctgtcattctagagtttaggtgagtaacacaattacaaagtgaaagatacagctagaaaatactacaaatcccatagtttttccattgcccaaggaagcatnaaatacgtatgtttgttcacctactcttatagtcaatgcgttcatcgtttcagcctaaaaataatagtctgtccctttagccagttttcatgtctgcacaagacctttcaataggcctttcaaatgataattcctccagaaaaccagtctaagggtgaggaccccaactctagc

SEQ ID NO: 3279 - DNA, 25 bp, Artificial sequence
  Affy probe set ID: 217525_at
ctgtccttccactaagcttggtaga

SEQ ID NO: 3280 - DNA, 25 bp, Artificial sequence
  Affy probe set ID: 217525_at
gtttgcacatcatttaattctcgtt

SEQ ID NO: 3281 - DNA, 25 bp, Artificial sequence
  Affy probe set ID: 217525_at
catgcacaagtctttacagctgtca

SEQ ID NO: 3282 - DNA, 25 bp, Artificial sequence
  Affy probe set ID: 217525_at
tacagctgtcattctagagtttagg

SEQ ID NO: 3283 - DNA, 25 bp, Artificial sequence
  Affy probe set ID: 217525_at
tacgtatgtttgttcacctactctt

SEQ ID NO: 3284 - DNA, 25 bp, Artificial sequence
  Affy probe set ID: 217525_at
gttcacctactcttatagtcaatgc

SEQ ID NO: 3285 - DNA, 25 bp, Artificial sequence
  Affy probe set ID: 217525_at
agtcaatgcgttcatcgtttcagcc

SEQ ID NO: 3286 - DNA, 25 bp, Artificial sequence
  Affy probe set ID: 217525_at
aatagtctgtccctttagccagttt

SEQ ID NO: 3287 - DNA, 25 bp, Artificial sequence
  Affy probe set ID: 217525_at
gccagttttcatgtctgcacaagac

SEQ ID NO: 3288 - DNA, 25 bp, Artificial sequence
  Affy probe set ID: 217525_at
agacctttcaataggcctttcaaat

SEQ ID NO: 3289 - DNA, 25 bp, Artificial sequence
  Affy probe set ID: 217525_at
taagggtgaggaccccaactctagc

SEQ ID NO: 3290 - DNA, 395 bp, Artificial sequence
  Target_Sequence, Fragment of GenBank Accession No. NM_001424
  misc_feature (28)..(28): n is a, c, g, or t
  misc_feature (47)..(48): n is a, c, g, or t
gagaatgcttgacttgttggtctgtgtnaatgtgtatatatatatanncctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtag

SEQ ID NO: 3291 - DNA, 25 bp, Artificial sequence
  Affy probe set ID: 225078_at
gagaatgcttgacttgttggtctgt

SEQ ID NO: 3292 - DNA, 25 bp, Artificial sequence
  Affy probe set ID: 225078_at
aacatcggagacctattcactccca

SEQ ID NO: 3293 - DNA, 25 bp, Artificial sequence
  Affy probe set ID: 225078_at
tcccacacactctgctatagtttgc

SEQ ID NO: 3294 - DNA, 25 bp, Artificial sequence
  Affy probe set ID: 225078_at
tatagtttgcgtgcttttgtggaca

SEQ ID NO: 3295 - DNA, 25 bp, Artificial sequence
  Affy probe set ID: 225078_at
cctcatgaacaggctggcgctctag

SEQ ID NO: 3296 - DNA, 25 bp, Artificial sequence
  Affy probe set ID: 225078_at
ctaggacgctctgtgttcactgatg

SEQ ID NO: 3297 - DNA, 25 bp, Artificial sequence
  Affy probe set ID: 225078_at
aacctagaactccaagcctgtttgt

SEQ ID NO: 3298 - DNA, 25 bp, Artificial sequence
  Affy probe set ID: 225078_at
cgtagtttaaaatctgcctcgcggg

SEQ ID NO: 3299 - DNA, 25 bp, Artificial sequence
  Affy probe set ID: 225078_at
tctgcctcgcgggatgttactaaac

SEQ ID NO: 3300 - DNA, 25 bp, Artificial sequence
  Affy probe set ID: 225078_at
gggcaaggcctagaggttcattttg

SEQ ID NO: 3301 - DNA, 25 bp, Artificial sequence
  Affy probe set ID: 225078_at
atcttggtttgtgactttagggtag

SEQ ID NO: 3302 - DNA, 350 bp, Artificial sequence
  Target_Sequence, Fragment of GenBank Accession No. NM_032575
  misc_feature (74)..(74): n is a, c, g, or t
gctctgcccctcgaaggggctatgagcaaggtaggagggagctggtctcctttcttcgggccccacccaggccntgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcat

SEQ ID NO: 3303 - DNA, 25 bp, Artificial sequence
  Affy probe set ID: 223378_at
gctctgcccctcgaaggggctatga

SEQ ID NO: 3304 - DNA, 25 bp, Artificial sequence
  Affy probe set ID: 223378_at
ccttaagtccctggcggggtcatgg

SEQ ID NO: 3305 - DNA, 25 bp, Artificial sequence
  Affy probe set ID: 223378_at
gggtcatgggtttgcgacttgagca

SEQ ID NO: 3306 - DNA, 25 bp, Artificial sequence
  Affy probe set ID: 223378_at
actggaaggccgacgagctcagcat

SEQ ID NO: 3307 - DNA, 25 bp, Artificial sequence
  Affy probe set ID: 223378_at
cgagctcagcatgcgactcggtgac

SEQ ID NO: 3308 - DNA, 25 bp, Artificial sequence
  Affy probe set ID: 223378_at
gctcggcagggccggtgtacttttt

SEQ ID NO: 3309 - DNA, 25 bp, Artificial sequence
  Affy probe set ID: 223378_at
gtggttgtcattggtgtgttgttgc

SEQ ID NO: 3310 - DNA, 25 bp, Artificial sequence
  Affy probe set ID: 223378_at
gttgttgcacattccaggacgtcag

SEQ ID NO: 3311 - DNA, 25 bp, Artificial sequence
  Affy probe set ID: 223378_at
ttctaagtgcctttctatcgtagct

SEQ ID NO: 3312 - DNA, 25 bp, Artificial sequence
  Affy probe set ID: 223378_at
ctatcgtagcttatgttttcctcct

SEQ ID NO: 3313 - DNA, 25 bp, Artificial sequence
  Affy probe set ID: 223378_at
ctcttggctccattgctgttagcat

SEQ ID NO: 3314 - DNA, 522 bp, Artificial sequence
  Target_Sequence, Fragment of GenBank Accession No. NM_007173
agatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgtaaaagaaaattataaaataattcaacatgtccatctttttagtgataataaaagaaagcatggtattaaactatcatagaagtagacagaaaaagaaaaaaggactcatggcattattaatataattagtgctttacatgtgttagttatacatattagaagcatatttgcctagtaaggctagtagaaccacatttcccaaagtgtgctccttaaacactcatgccttatgattttctaccaaaagtaaaaagggttgtattaagtcagaggaagatgcctctccattttccctctctttatcagaggttcacatgcctgtctgcacattaaaagctctgggaagacctgttgtaa

SEQ ID NO: 3315 - DNA, 25 bp, Artificial sequence
  Affy probe set ID: 226279_at
agatgttccttttgtgaagcacctt

SEQ ID NO: 3316 - DNA, 25 bp, Artificial sequence
  Affy probe set ID: 226279_at
gaagcaccttgattccttgattttg

SEQ ID NO: 3317 - DNA, 25 bp, Artificial sequence
  Affy probe set ID: 226279_at
gaatgatacacccatatgctatata

SEQ ID NO: 3318 - DNA, 25 bp, Artificial sequence
  Affy probe set ID: 226279_at
gctatatacagcttaactcacagaa

SEQ ID NO: 3319 - DNA, 25 bp, Artificial sequence
  Affy probe set ID: 226279_at
aaaataattcaacatgtccatcttt

SEQ ID NO: 3320 - DNA, 25 bp, Artificial sequence
  Affy probe set ID: 226279_at
ggctagtagaaccacatttcccaaa

SEQ ID NO: 3321 - DNA, 25 bp, Artificial sequence
  Affy probe set ID: 226279_at
agtgtgctccttaaacactcatgcc

SEQ ID NO: 3322 - DNA, 25 bp, Artificial sequence
  Affy probe set ID: 226279_at
aaacactcatgccttatgattttct

SEQ ID NO: 3323 - DNA, 25 bp, Artificial sequence
  Affy probe set ID: 226279_at
tccctctctttatcagaggttcaca

SEQ ID NO: 3324 - DNA, 25 bp, Artificial sequence
  Affy probe set ID: 226279_at
gttcacatgcctgtctgcacattaa

SEQ ID NO: 3325 - DNA, 25 bp, Artificial sequence
  Affy probe set ID: 226279_at
aaagctctgggaagacctgttgtaa

SEQ ID NO: 3326 - DNA, 560 bp, Artificial sequence
  Target_Sequence, Fragment of GenBank Accession No. NM_001015880
agctgccttctcggatactgaaaggtcgagttttctgaactgcactgattttattgcagttgaaaaacccaaagctattccaaagatttcaagctgttctgagacatcttctgatggctttacttcctgagaggcaatgtttttactttatgcataattcattgttgccaaggaataaagtgaagaaacagcacctttttaatatataggtctctctggaagagacctaaatttagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattt

SEQ ID NO: 3327 - DNA, 25 bp, Artificial sequence
  Affy probe set ID: 203060_s_at
agctgccttctcggatactgaaagg

SEQ ID NO: 3328 - DNA, 25 bp, Artificial sequence
  Affy probe set ID: 203060_s_at
tgaaaggtcgagttttctgaactgc

SEQ ID NO: 3329 - DNA, 25 bp, Artificial sequence
  Affy probe set ID: 203060_s_at
gatttcaagctgttctgagacatct

SEQ ID NO: 3330 - DNA, 25 bp, Artificial sequence
  Affy probe set ID: 203060_s_at
gctttacttcctgagaggcaatgtt

SEQ ID NO: 3331 - DNA, 25 bp, Artificial sequence
  Affy probe set ID: 203060_s_at
aactgtgacaattttcatattctca

SEQ ID NO: 3332 - DNA, 25 bp, Artificial sequence
  Affy probe set ID: 203060_s_at
agttacacacaatggccacagcagt

SEQ ID NO: 3333 - DNA, 25 bp, Artificial sequence
  Affy probe set ID: 203060_s_at
tagtgcctatactcatgtaatcggt

SEQ ID NO: 3334 - DNA, 25 bp, Artificial sequence
  Affy probe set ID: 203060_s_at
tgtaatcggttactcactactgcct

SEQ ID NO: 3335 - DNA, 25 bp, Artificial sequence
  Affy probe set ID: 203060_s_at
acaggattatagtgccttaaccgat

SEQ ID NO: 3336 - DNA, 25 bp, Artificial sequence
  Affy probe set ID: 203060_s_at
atttaaaactgctcttctgctctag

SEQ ID NO: 3337 - DNA, 25 bp, Artificial sequence
  Affy probe set ID: 203060_s_at
gtacaactgatgcttgttcttattt

SEQ ID NO: 3338 - DNA, 472 bp, Artificial sequence
  Target_Sequence, Fragment of GenBank Accession No. NM_015645
gggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaa

SEQ ID NO: 3339 - DNA, 25 bp, Artificial sequence
  Affy probe set ID: 223499_at
gggtgactacattggcatctatgcc

SEQ ID NO: 3340 - DNA, 25 bp, Artificial sequence
  Affy probe set ID: 223499_at
gccagcatcaagacagacagcacct

SEQ ID NO: 3341 - DNA, 25 bp, Artificial sequence
  Affy probe set ID: 223499_at
accttctccggatttctggtgtact

SEQ ID NO: 3342 - DNA, 25 bp, Artificial sequence
  Affy probe set ID: 223499_at
ctcatgctctcactcctagaaggag

SEQ ID NO: 3343 - DNA, 25 bp, Artificial sequence
  Affy probe set ID: 223499_at
aggctgacaaccaggtcatccagga

SEQ ID NO: 3344 - DNA, 25 bp, Artificial sequence
  Affy probe set ID: 223499_at
tggcccccctggaatattgtgaatg

SEQ ID NO: 3345 - DNA, 25 bp, Artificial sequence
  Affy probe set ID: 223499_at
gaacagtggctgtctgcgatcaggt

SEQ ID NO: 3346 - DNA, 25 bp, Artificial sequence
  Affy probe set ID: 223499_at
gcgatcaggtctggcagcatggggc

SEQ ID NO: 3347 - DNA, 25 bp, Artificial sequence
  Affy probe set ID: 223499_at
cagtggctggatttctgcccaagac

SEQ ID NO: 3348 - DNA, 25 bp, Artificial sequence
  Affy probe set ID: 223499_at
ctgtgctggcaagtgtaagtccccc

SEQ ID NO: 3349 - DNA, 25 bp, Artificial sequence
  Affy probe set ID: 223499_at
ggcccttttctcagagatcactcaa

SEQ ID NO: 3350 - DNA, 391 bp, Artificial sequence
  Target_Sequence, Fragment of GenBank Accession No. AK130049
ataccagatttatgtcctgttcaacaactcagtactctaaatgttgttatgcttttaataagaccttcccagataataatcttggagctcttttcccagctgtctaccatgcatttgcaacaggaggaagatgtaatgaatatgcagtattaagttgatttatgaacagtgctttgatatgccaaagggaaaactgtcccacttaaattagattaagtagggtggctaaaaataaataaaaacactggaaattctttctctcactttctcttgatgcaatgaagggaatatgacactacagtatacagagttgttgttatatgatgcacaaaatattttgatgatttgaataaatgttaacttttaatctgcgccttaataatgactggtt

SEQ ID NO: 3351 - DNA, 25 bp, Artificial sequence
  Affy probe set ID: 213429_at
ataccagatttatgtcctgttcaac

SEQ ID NO: 3352 - DNA, 25 bp, Artificial sequence
  Affy probe set ID: 213429_at
gtcctgttcaacaactcagtactct

SEQ ID NO: 3353 - DNA, 25 bp, Artificial sequence
  Affy probe set ID: 213429_at
gtactctaaatgttgttatgctttt

SEQ ID NO: 3354 - DNA, 25 bp, Artificial sequence
  Affy probe set ID: 213429_at
tatgcttttaataagaccttcccag

SEQ ID NO: 3355 - DNA, 25 bp, Artificial sequence
  Affy probe set ID: 213429_at
gaccttcccagataataatcttgga

SEQ ID NO: 3356 - DNA, 25 bp, Artificial sequence
  Affy probe set ID: 213429_at
taatcttggagctcttttcccagct

SEQ ID NO: 3357 - DNA, 25 bp, Artificial sequence
  Affy probe set ID: 213429_at
agctgtctaccatgcatttgcaaca

SEQ ID NO: 3358 - DNA, 25 bp, Artificial sequence
  Affy probe set ID: 213429_at
gaaaactgtcccacttaaattagat

SEQ ID NO: 3359 - DNA, 25 bp, Artificial sequence
  Affy probe set ID: 213429_at
ctggaaattctttctctcactttct

SEQ ID NO: 3360 - DNA, 25 bp, Artificial sequence
  Affy probe set ID: 213429_at
taacttttaatctgcgccttaataa

SEQ ID NO: 3361 - DNA, 25 bp, Artificial sequence
  Affy probe set ID: 213429_at
atctgcgccttaataatgactggtt

SEQ ID NO: 3362 - DNA, 361 bp, Artificial sequence
  Target_Sequence, Fragment of GenBank Accession No. NM_001849
gcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaacgagaacgtggtacccaccgtcctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggccc

SEQ ID NO: 3363 - DNA, 25 bp, Artificial sequence
  Affy probe set ID: 209156_s_at
gcacgccatcaatgccatcgtgcgc

SEQ ID NO: 3364 - DNA, 25 bp, Artificial sequence
  Affy probe set ID: 209156_s_at
tcacgggcaacgacagtctgcacga

SEQ ID NO: 3365 - DNA, 25 bp, Artificial sequence
  Affy probe set ID: 209156_s_at
gggcaacgacagtctgcacgagtcg

SEQ ID NO: 3366 - DNA, 25 bp, Artificial sequence
  Affy probe set ID: 209156_s_at
gcaacgacagtctgcacgagtcggc

SEQ ID NO: 3367 - DNA, 25 bp, Artificial sequence
  Affy probe set ID: 209156_s_at
aacgacagtctgcacgagtcggcgc

SEQ ID NO: 3368 - DNA, 25 bp, Artificial sequence
  Affy probe set ID: 209156_s_at
gggcagcgacgtggacatggacgtg

SEQ ID NO: 3369 - DNA, 25 bp, Artificial sequence
  Affy probe set ID: 209156_s_at
gcgacgtggacatggacgtgctcac

SEQ ID NO: 3370 - DNA, 25 bp, Artificial sequence
  Affy probe set ID: 209156_s_at
acgtggacatggacgtgctcaccac

SEQ ID NO: 3371 - DNA, 25 bp, Artificial sequence
  Affy probe set ID: 209156_s_at
cacgagaaggactatgacagcctgg

SEQ ID NO: 3372 - DNA, 25 bp, Artificial sequence
  Affy probe set ID: 209156_s_at
accccgtccatggtgctaagcgggc

SEQ ID NO: 3373 - DNA, 25 bp, Artificial sequence
  Affy probe set ID: 209156_s_at
cccgtccatggtgctaagcgggccc

SEQ ID NO: 3374 - DNA, 353 bp, Artificial sequence
  Target_Sequence, Fragment of GenBank Accession No. NM_001014796
agtgtcaggtgccttgcaggaaaataatctgagtcccaagctagcctgtgctcatccacaatcacaatgaacatgtcaaggaagaatttgcagagactcaagggaagcacaatgggataaggtaatcactttcagtgaaaaactgttttcttgaaaacaggcttggacacaattgaaagctggcttcctgcaaacacaccaagagtctgtaatctagcctatccattatatgtcctttattattcatgatatcctattcttctaccttgttgcctggtaactttttctgaggactgagtttctgcagcgatgtggtgcactcttcctgtgatgaggaaacatctgggccccct

SEQ ID NO: 3375 - DNA, 25 bp, Artificial sequence
  Affy probe set ID: 225442_at
agtgtcaggtgccttgcaggaaaat

SEQ ID NO: 3376 - DNA, 25 bp, Artificial sequence
  Affy probe set ID: 225442_at
aataatctgagtcccaagctagcct

SEQ ID NO: 3377 - DNA, 25 bp, Artificial sequence
  Affy probe set ID: 225442_at
gcttcctgcaaacacaccaagagtc

SEQ ID NO: 3378 - DNA, 25 bp, Artificial sequence
  Affy probe set ID: 225442_at
gagtctgtaatctagcctatccatt

SEQ ID NO: 3379 - DNA, 25 bp, Artificial sequence
  Affy probe set ID: 225442_at
tagcctatccattatatgtccttta

SEQ ID NO: 3380 - DNA, 25 bp, Artificial sequence
  Affy probe set ID: 225442_at
tcatgatatcctattcttctacctt

SEQ ID NO: 3381 - DNA, 25 bp, Artificial sequence
  Affy probe set ID: 225442_at
ttcttctaccttgttgcctggtaac

SEQ ID NO: 3382 - DNA, 25 bp, Artificial sequence
  Affy probe set ID: 225442_at
gcctggtaactttttctgaggactg

SEQ ID NO: 3383 - DNA, 25 bp, Artificial sequence
  Affy probe set ID: 225442_at
gtttctgcagcgatgtggtgcactc

SEQ ID NO: 3384 - DNA, 25 bp, Artificial sequence
  Affy probe set ID: 225442_at
tggtgcactcttcctgtgatgagga

SEQ ID NO: 3385 - DNA, 25 bp, Artificial sequence
  Affy probe set ID: 225442_at
tgatgaggaaacatctgggccccct

SEQ ID NO: 3386 - DNA, 506 bp, Artificial sequence
  Target_Sequence, Fragment of GenBank Accession No. NM_015463
  misc_feature (86)..(86): n is a, c, g, or t
  misc_feature (118)..(118): n is a, c, g, or t
acttttgaccacttgtgactggagttcagtggccctggcaggcttgtcctgctcttgaccattccactgactaactttggtgtttngtttccaagttaagtgattcctcctttttttngttcaatgttaaatttaaaaataacaatgtgtatgggtcctcccatgtgtaatatggtaacatgtaacttgcagtgtttgccagctttcaaagcaggctttgtgaaaatgtaatacaaacagcagtgaatgggactcaaatgttgtgcttcctataaacagctccgctctttcagggaaggatggtaacaaactagaaggacaaatatgtacgtatttataacgtattaaaactcttttaagtagcttaaggtattgtgcaatggcctagcctagtagaaatgggggaaaagcattgctgtggaccattgttaaagtgacaggagttgtagggttacccctttgacaagcttccatagtcttcagacacgcacattgatggcatccct

SEQ ID NO: 3387 - DNA, 25 bp, Artificial sequence
  Affy probe set ID: 226751_at
acttttgaccacttgtgactggagt

SEQ ID NO: 3388 - DNA, 25 bp, Artificial sequence
  Affy probe set ID: 226751_at
cattccactgactaactttggtgtt

SEQ ID NO: 3389 - DNA, 25 bp, Artificial sequence
  Affy probe set ID: 226751_at
tccaagttaagtgattcctcctttt

SEQ ID NO: 3390 - DNA, 25 bp, Artificial sequence
  Affy probe set ID: 226751_at
ataacaatgtgtatgggtcctccca

SEQ ID NO: 3391 - DNA, 25 bp, Artificial sequence
  Affy probe set ID: 226751_at
aacttgcagtgtttgccagctttca

SEQ ID NO: 3392 - DNA, 25 bp, Artificial sequence
  Affy probe set ID: 226751_at
gggactcaaatgttgtgcttcctat

SEQ ID NO: 3393 - DNA, 25 bp, Artificial sequence
  Affy probe set ID: 226751_at
ctataaacagctccgctctttcagg

SEQ ID NO: 3394 - DNA, 25 bp, Artificial sequence
  Affy probe set ID: 226751_at
aggtattgtgcaatggcctagccta

SEQ ID NO: 3395 - DNA, 25 bp, Artificial sequence
  Affy probe set ID: 226751_at
aaaagcattgctgtggaccattgtt

SEQ ID NO: 3396 - DNA, 25 bp, Artificial sequence
  Affy probe set ID: 226751_at
acccctttgacaagcttccatagtc

SEQ ID NO: 3397 - DNA, 25 bp, Artificial sequence
  Affy probe set ID: 226751_at
agacacgcacattgatggcatccct

SEQ ID NO: 3398 - DNA, 487 bp, Artificial sequence
  Target_Sequence, Fragment of GenBank Accession No. AK055628
  misc_feature (296)..(296): n is a, c, g, or t
tataaggtaactctttagtcctccatttagcacattttaaatcctccaaagaataagtatcatgtgattattttagctttacaaaaaaaaagttgaatggcgttttattttcatggcctataagcaggtaccttagtagggcagatataggaaaaacaaattagagcaaaacaaatcctctacaaatccaaggcaggaaaagtggtggcagagtgactcattctcctgtccctcccatcaggtcaaatcaggaggctgcagtgaatgcctgttctttgaatgtgtagcagttgttncctgtaactctttaaaacttggctataggctgtttagcacagtacagattaaagatacagttacgtaaacagcaaagtaattttatagtgcttcatccatttatcatgctttggtttgctaattttttcacatacctttttctatcacagtctgttgcttttgtacacatttctcatattggggttcgaca

SEQ ID NO: 3399 - DNA, 25 bp, Artificial sequence
  Affy probe set ID: 226777_at
tataaggtaactctttagtcctcca

SEQ ID NO: 3400 - DNA, 25 bp, Artificial sequence
  Affy probe set ID: 226777_at
ttagtcctccatttagcacatttta

SEQ ID NO: 3401 - DNA, 25 bp, Artificial sequence
  Affy probe set ID: 226777_at
atggcgttttattttcatggcctat

SEQ ID NO: 3402 - DNA, 25 bp, Artificial sequence
  Affy probe set ID: 226777_at
catggcctataagcaggtaccttag

SEQ ID NO: 3403 - DNA, 25 bp, Artificial sequence
  Affy probe set ID: 226777_at
aaatcctctacaaatccaaggcagg

SEQ ID NO: 3404 - DNA, 25 bp, Artificial sequence
  Affy probe set ID: 226777_at
tggcagagtgactcattctcctgtc

SEQ ID NO: 3405 - DNA, 25 bp, Artificial sequence
  Affy probe set ID: 226777_at
agtgcttcatccatttatcatgctt

SEQ ID NO: 3406 - DNA, 25 bp, Artificial sequence
  Affy probe set ID: 226777_at
catgctttggtttgctaattttttc

SEQ ID NO: 3407 - DNA, 25 bp, Artificial sequence
  Affy probe set ID: 226777_at
cacatacctttttctatcacagtct

SEQ ID NO: 3408 - DNA, 25 bp, Artificial sequence
  Affy probe set ID: 226777_at
atcacagtctgttgcttttgtacac

SEQ ID NO: 3409 - DNA, 25 bp, Artificial sequence
  Affy probe set ID: 226777_at
acatttctcatattggggttcgaca

SEQ ID NO: 3410 - DNA, 483 bp, Artificial sequence
  Target_Sequence, Fragment of GenBank Accession No. NM_014799
ttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgtt

SEQ ID NO: 3411 - DNA, 25 bp, Artificial sequence
  Affy probe set ID: 203903_s_at
ttagtttctttgctctacgtgggca

SEQ ID NO: 3412 - DNA, 25 bp, Artificial sequence
  Affy probe set ID: 203903_s_at
ggagtaccttattatcctacatcgc

SEQ ID NO: 3413 - DNA, 25 bp, Artificial sequence
  Affy probe set ID: 203903_s_at
acatcgcaaatttcaacagctacat

SEQ ID NO: 3414 - DNA, 25 bp, Artificial sequence
  Affy probe set ID: 203903_s_at
gctacattatatttccttctgacac

SEQ ID NO: 3415 - DNA, 25 bp, Artificial sequence
  Affy probe set ID: 203903_s_at
gaaatgtatccttctcacaaagtag

SEQ ID NO: 3416 - DNA, 25 bp, Artificial sequence
  Affy probe set ID: 203903_s_at
gattctccttggcagtgaactactt

SEQ ID NO: 3417 - DNA, 25 bp, Artificial sequence
  Affy probe set ID: 203903_s_at
atgggttgttgctgccatgagcatg

SEQ ID NO: 3418 - DNA, 25 bp, Artificial sequence
  Affy probe set ID: 203903_s_at
gagcatgtacaacctctggagctag

SEQ ID NO: 3419 - DNA, 25 bp, Artificial sequence
  Affy probe set ID: 203903_s_at
ctcctcaggaaagccagttctccaa

SEQ ID NO: 3420 - DNA, 25 bp, Artificial sequence
  Affy probe set ID: 203903_s_at
ccaagttcttaacctgtggcactga

SEQ ID NO: 3421 - DNA, 25 bp, Artificial sequence
  Affy probe set ID: 203903_s_at
gaatgttgagttacctcttcatgtt

SEQ ID NO: 3422 - DNA, 552 bp, Artificial sequence
  Target_Sequence, Fragment of GenBank Accession No. NM_004385
  misc_feature (63)..(63): n is a, c, g, or t
  misc_feature (72)..(72): n is a, c, g, or t
  misc_feature (74)..(74): n is a, c, g, or t
  misc_feature (85)..(85): n is a, c, g, or t
  misc_feature (138)..(138): n is a, c, g, or t
tttcagcaccgatggccatgtaaataagatgatttaatgttgattttaatcctgtatataaantaaaaagtncncaatgagtttngggcatatttaatgatgattatggagccttagaggtctttaatcattggttcnggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggg

SEQ ID NO: 3423 - DNA, 25 bp, Artificial sequence
  Affy probe set ID: 221731_x_at
tttcagcaccgatggccatgtaaat

SEQ ID NO: 3424 - DNA, 25 bp, Artificial sequence
  Affy probe set ID: 221731_x_at
gaaatggtttcacttgctctttgac

SEQ ID NO: 3425 - DNA, 25 bp, Artificial sequence
  Affy probe set ID: 221731_x_at
gaagatggcttttcctggacagcta

SEQ ID NO: 3426 - DNA, 25 bp, Artificial sequence
  Affy probe set ID: 221731_x_at
tgtaggtcattgcacctatctcagc

SEQ ID NO: 3427 - DNA, 25 bp, Artificial sequence
  Affy probe set ID: 221731_x_at
ggtgcagtttgcttctacatgatgc

SEQ ID NO: 3428 - DNA, 25 bp, Artificial sequence
  Affy probe set ID: 221731_x_at
ggctgcgaatgggatcctgatggaa

SEQ ID NO: 3429 - DNA, 25 bp, Artificial sequence
  Affy probe set ID: 221731_x_at
ccaatgtcgaactcttctttgctgc

SEQ ID NO: 3430 - DNA, 25 bp, Artificial sequence
  Affy probe set ID: 221731_x_at
cattcctttttcttcacttacaaga

SEQ ID NO: 3431 - DNA, 25 bp, Artificial sequence
  Affy probe set ID: 221731_x_at
ggtctactttttaatggctttcata

SEQ ID NO: 3432 - DNA, 25 bp, Artificial sequence
  Affy probe set ID: 221731_x_at
aaggttaccgatcaatgcatttcat

SEQ ID NO: 3433 - DNA, 25 bp, Artificial sequence
  Affy probe set ID: 221731_x_at
agacctagggctctggagggtgggg

SEQ ID NO: 3434 - DNA, 401 bp, Artificial sequence
  Target_Sequence, Fragment of GenBank Accession No. NM_152330
  misc_feature (255)..(255): n is a, c, g, or t
tttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattgtttttaaaaataaaaaggaaaggaaatatanaaagctgttatttattctgcatttcttacatatctatcgcttgtcagtatacccgttttggtatatattgcctctgcacatctacatttgtatatgcaacagtgagctttatatctacataaactgtaaataatcctttctgtgaa

SEQ ID NO: 3435 - DNA, 25 bp, Artificial sequence
  Affy probe set ID: 225481_at
tttctctctacttcaaccaaaatca

SEQ ID NO: 3436 - DNA, 25 bp, Artificial sequence
  Affy probe set ID: 225481_at
aaaatcagatctttgaggttttgct

SEQ ID NO: 3437 - DNA, 25 bp, Artificial sequence
  Affy probe set ID: 225481_at
gaggttttgctgacattgttggtgg

SEQ ID NO: 3438 - DNA, 25 bp, Artificial sequence
  Affy probe set ID: 225481_at
ttgttggtggttttgcacatgttct

SEQ ID NO: 3439 - DNA, 25 bp, Artificial sequence
  Affy probe set ID: 225481_at
aagaacacttctgctttttgatcca

SEQ ID NO: 3440 - DNA, 25 bp, Artificial sequence
  Affy probe set ID: 225481_at
cactttgaataatccatgttttgta

SEQ ID NO: 3441 - DNA, 25 bp, Artificial sequence
  Affy probe set ID: 225481_at
tctgcatttcttacatatctatcgc

SEQ ID NO: 3442 - DNA, 25 bp, Artificial sequence
  Affy probe set ID: 225481_at
atctatcgcttgtcagtatacccgt

SEQ ID NO: 3443 - DNA, 25 bp, Artificial sequence
  Affy probe set ID: 225481_at
gcttgtcagtatacccgttttggta

SEQ ID NO: 3444 - DNA, 25 bp, Artificial sequence
  Affy probe set ID: 225481_at
aacagtgagctttatatctacataa

SEQ ID NO: 3445 - DNA, 25 bp, Artificial sequence
  Affy probe set ID: 225481_at
aactgtaaataatcctttctgtgaa

SEQ ID NO: 3446 - DNA, 313 bp, Artificial sequence
  Target_Sequence, Fragment of GenBank Accession No. BQ917964
agttcagctgcttctattggtaagaaaattcaacttcctaccagccttagaaaggtctctttaaacaatttctttccccctagggttacctagctggtccatacaggttttatcacctcactgcaaggaggaagttgaatattctgttccccacggggatctggcttaatccctagttgctcatatagttggtatcagcatagcaatattttgcataatgctttatttttctcaaatgactattgcatagatgatcttgatatttgcaacagcctagtggatttggtagggtcctgaatcatctctataaggc

SEQ ID NO: 3447 - DNA, 25 bp, Artificial sequence
  Affy probe set ID: 235733_at
agttcagctgcttctattggtaaga

SEQ ID NO: 3448 - DNA, 25 bp, Artificial sequence
  Affy probe set ID: 235733_at
ttcaacttcctaccagccttagaaa

SEQ ID NO: 3449 - DNA, 25 bp, Artificial sequence
  Affy probe set ID: 235733_at
tagggttacctagctggtccataca

SEQ ID NO: 3450 - DNA, 25 bp, Artificial sequence
  Affy probe set ID: 235733_at
ctagctggtccatacaggttttatc

SEQ ID NO: 3451 - DNA, 25 bp, Artificial sequence
  Affy probe set ID: 235733_at
gaagttgaatattctgttccccacg

SEQ ID NO: 3452 - DNA, 25 bp, Artificial sequence
  Affy probe set ID: 235733_at
tgttccccacggggatctggcttaa

SEQ ID NO: 3453 - DNA, 25 bp, Artificial sequence
  Affy probe set ID: 235733_at
tggcttaatccctagttgctcatat

SEQ ID NO: 3454 - DNA, 25 bp, Artificial sequence
  Affy probe set ID: 235733_at
tagttgctcatatagttggtatcag

SEQ ID NO: 3455 - DNA, 25 bp, Artificial sequence
  Affy probe set ID: 235733_at
gatatttgcaacagcctagtggatt

SEQ ID NO: 3456 - DNA, 25 bp, Artificial sequence
  Affy probe set ID: 235733_at
tagtggatttggtagggtcctgaat

SEQ ID NO: 3457 - DNA, 25 bp, Artificial sequence
  Affy probe set ID: 235733_at
gggtcctgaatcatctctataaggc

SEQ ID NO: 3458 - DNA, 525 bp, Artificial sequence
  Target_Sequence, Fragment of GenBank Accession No. NM_002615
caactgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacag

SEQ ID NO: 3459 - DNA, 25 bp, Artificial sequence
  Affy probe set ID: 202283_at
caactgcccttgaccggaagcatga

SEQ ID NO: 3460 - DNA, 25 bp, Artificial sequence
  Affy probe set ID: 202283_at
agcatgagtatcatcttcttcctgc

SEQ ID NO: 3461 - DNA, 25 bp, Artificial sequence
  Affy probe set ID: 202283_at
agtgacccagaatttgaccttgata

SEQ ID NO: 3462 - DNA, 25 bp, Artificial sequence
  Affy probe set ID: 202283_at
tgatagaggagagcctcacctccga

SEQ ID NO: 3463 - DNA, 25 bp, Artificial sequence
  Affy probe set ID: 202283_at
tcacctccgagttcattcatgacat

SEQ ID NO: 3464 - DNA, 25 bp, Artificial sequence
  Affy probe set ID: 202283_at
ggagatgaagctgcaatccttgttt

SEQ ID NO: 3465 - DNA, 25 bp, Artificial sequence
  Affy probe set ID: 202283_at
atccttgtttgattcaccagacttt

SEQ ID NO: 3466 - DNA, 25 bp, Artificial sequence
  Affy probe set ID: 202283_at
gcaaacccatcaagctgactcaggt

SEQ ID NO: 3467 - DNA, 25 bp, Artificial sequence
  Affy probe set ID: 202283_at
aacaccgggctggctttgagtggaa

SEQ ID NO: 3468 - DNA, 25 bp, Artificial sequence
  Affy probe set ID: 202283_at
ggcccctaatatcccagtttaatat

SEQ ID NO: 3469 - DNA, 25 bp, Artificial sequence
  Affy probe set ID: 202283_at
acccgagggacagcagattccacag

SEQ ID NO: 3470 - DNA, 496 bp, Artificial sequence
  Target_Sequence, Fragment of GenBank Accession No. NM_032348
  misc_feature (223)..(223): n is a, c, g, or t
  misc_feature (454)..(454): n is a, c, g, or t
tcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccntgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctngtggacctgccaccatcacaataaagtccccatctgattttt

SEQ ID NO: 3471 - DNA, 25 bp, Artificial sequence
  Affy probe set ID: 213422_s_at
tcctggaggaggacactcccatcag

SEQ ID NO: 3472 - DNA, 25 bp, Artificial sequence
  Affy probe set ID: 213422_s_at
actcccatcagaacttggcagcctt

SEQ ID NO: 3473 - DNA, 25 bp, Artificial sequence
  Affy probe set ID: 213422_s_at
ccccacctgtaccaccatgtgggac

SEQ ID NO: 3474 - DNA, 25 bp, Artificial sequence
  Affy probe set ID: 213422_s_at
gtaccaccatgtgggactccaggca

SEQ ID NO: 3475 - DNA, 25 bp, Artificial sequence
  Affy probe set ID: 213422_s_at
ctctcagccaccttgatagtcactg

SEQ ID NO: 3476 - DNA, 25 bp, Artificial sequence
  Affy probe set ID: 213422_s_at
agccaccttgatagtcactgggctc

SEQ ID NO: 3477 - DNA, 25 bp, Artificial sequence
  Affy probe set ID: 213422_s_at
tctagggctggggctacatttggct

SEQ ID NO: 3478 - DNA, 25 bp, Artificial sequence
  Affy probe set ID: 213422_s_at
ttggcttctgtactggctgaggaca

SEQ ID NO: 3479 - DNA, 25 bp, Artificial sequence
  Affy probe set ID: 213422_s_at
tttggggtggcctgtgttgccactc

SEQ ID NO: 3480 - DNA, 25 bp, Artificial sequence
  Affy probe set ID: 213422_s_at
ctgccaccatcacaataaagtcccc

SEQ ID NO: 3481 - DNA, 25 bp, Artificial sequence
  Affy probe set ID: 213422_s_at
acaataaagtccccatctgattttt

SEQ ID NO: 3482 - DNA, 447 bp, Artificial sequence
  Target_Sequence, Fragment of GenBank Accession No. NM_006106
acacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtactt

SEQ ID NO: 3483 - DNA, 25 bp, Artificial sequence
  Affy probe set ID: 224894_at
acacagggaagtgactttgctacaa

SEQ ID NO: 3484 - DNA, 25 bp, Artificial sequence
  Affy probe set ID: 224894_at
aatacatgccttctatatggaacat

SEQ ID NO: 3485 - DNA, 25 bp, Artificial sequence
  Affy probe set ID: 224894_at
tcagaattcataccaatcagtgttg

SEQ ID NO: 3486 - DNA, 25 bp, Artificial sequence
  Affy probe set ID: 224894_at
gtgcttaacacttttctagcgttgg

SEQ ID NO: 3487 - DNA, 25 bp, Artificial sequence
  Affy probe set ID: 224894_at
cttttctagcgttggtacatctgag

SEQ ID NO: 3488 - DNA, 25 bp, Artificial sequence
  Affy probe set ID: 224894_at
gagtgctcaggtggattttatcctc

SEQ ID NO: 3489 - DNA, 25 bp, Artificial sequence
  Affy probe set ID: 224894_at
gattttatcctcgcaagcatgttgt

SEQ ID NO: 3490 - DNA, 25 bp, Artificial sequence
  Affy probe set ID: 224894_at
gaattgtgggtgtgcctatcataac

SEQ ID NO: 3491 - DNA, 25 bp, Artificial sequence
  Affy probe set ID: 224894_at
gagaattctttaatgcacacttgtc

SEQ ID NO: 3492 - DNA, 25 bp, Artificial sequence
  Affy probe set ID: 224894_at
tatagtaccaatgttacctttttat

SEQ ID NO: 3493 - DNA, 25 bp, Artificial sequence
  Affy probe set ID: 224894_at
gagcatgctcatatgttaggtactt

SEQ ID NO: 3494 - DNA, 313 bp, Artificial sequence
  Target_Sequence, Fragment of GenBank Accession No. NM_020182
aatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccag

SEQ ID NO: 3495 - DNA, 25 bp, Artificial sequence
  Affy probe set ID: 222449_at
aatatgtcagtgcttgcttgatgga

SEQ ID NO: 3496 - DNA, 25 bp, Artificial sequence
  Affy probe set ID: 222449_at
tggaaacttctcttgtgtctgttga

SEQ ID NO: 3497 - DNA, 25 bp, Artificial sequence
  Affy probe set ID: 222449_at
aatgtcggaatttcagagtcgcctg

SEQ ID NO: 3498 - DNA, 25 bp, Artificial sequence
  Affy probe set ID: 222449_at
agtcgcctgacggcagagggtgagc

SEQ ID NO: 3499 - DNA, 25 bp, Artificial sequence
  Affy probe set ID: 222449_at
cagagaggccttggccaggagcggc

SEQ ID NO: 3500 - DNA, 25 bp, Artificial sequence
  Affy probe set ID: 222449_at
actgtccctgcagagtggatgcttc

SEQ ID NO: 3501 - DNA, 25 bp, Artificial sequence
  Affy probe set ID: 222449_at
ggatgcttctgcctagtgacaggtt

SEQ ID NO: 3502 - DNA, 25 bp, Artificial sequence
  Affy probe set ID: 222449_at
atcaccacgttatatattccctacc

SEQ ID NO: 3503 - DNA, 25 bp, Artificial sequence
  Affy probe set ID: 222449_at
tattccctaccgaaggagacacctt

SEQ ID NO: 3504 - DNA, 25 bp, Artificial sequence
  Affy probe set ID: 222449_at
acccagaacagcctttaaatcacaa

SEQ ID NO: 3505 - DNA, 25 bp, Artificial sequence
  Affy probe set ID: 222449_at
taaccacggaggcaccgagttccag

SEQ ID NO: 3506 - DNA, 421 bp, Artificial sequence
  Target_Sequence, Fragment of GenBank Accession No. CB999028
tcatttctagagtacctgagccaaacaaatacacaacggaagctgcagctgtatcatcactagcaatttgctcatcattatttactacctttgaacctaaggtttcctgcctatgcttttgaaagcaaaaatcagtctcctttgcatgaaaaagagccttagatttttaaacatgttagttaccagaatgctaaaataccagttgattacccaaattattttggaaatctatccataatggaagtctacaacaaacacataaaacagattacactaagagctgagaaattcaaaggaactgaagattctgagagataaactgttcaagtcttagcaatgatactgcacttctctttgacaggttctgggcttaagttagaggccctactggttccaaaccatattccactgactttgcaag

SEQ ID NO: 3507 - DNA, 25 bp, Artificial sequence
  Affy probe set ID: 226834_at
tcatttctagagtacctgagccaaa

SEQ ID NO: 3508 - DNA, 25 bp, Artificial sequence
  Affy probe set ID: 226834_at
aaatacacaacggaagctgcagctg

SEQ ID NO: 3509 - DNA, 25 bp, Artificial sequence
  Affy probe set ID: 226834_at
gctgcagctgtatcatcactagcaa

SEQ ID NO: 3510 - DNA, 25 bp, Artificial sequence
  Affy probe set ID: 226834_at
atcattatttactacctttgaacct

SEQ ID NO: 3511 - DNA, 25 bp, Artificial sequence
  Affy probe set ID: 226834_at
tttgaacctaaggtttcctgcctat

SEQ ID NO: 3512 - DNA, 25 bp, Artificial sequence
  Affy probe set ID: 226834_at
gctaaaataccagttgattacccaa

SEQ ID NO: 3513 - DNA, 25 bp, Artificial sequence
  Affy probe set ID: 226834_at
cttagcaatgatactgcacttctct

SEQ ID NO: 3514 - DNA, 25 bp, Artificial sequence
  Affy probe set ID: 226834_at
cacttctctttgacaggttctgggc

SEQ ID NO: 3515 - DNA, 25 bp, Artificial sequence
  Affy probe set ID: 226834_at
taagttagaggccctactggttcca

SEQ ID NO: 3516 - DNA, 25 bp, Artificial sequence
  Affy probe set ID: 226834_at
gttccaaaccatattccactgactt

SEQ ID NO: 3517 - DNA, 25 bp, Artificial sequence
  Affy probe set ID: 226834_at
aaccatattccactgactttgcaag

SEQ ID NO: 3518 - DNA, 479 bp, Artificial sequence
  Target_Sequence, Fragment of GenBank Accession No. NM_001711
tctctctttctgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacacc

SEQ ID NO: 3519 - DNA, 25 bp, Artificial sequence
  Affy probe set ID: 201261_x_at
tctctctttctgtgtgtgtgtgtgt

SEQ ID NO: 3520 - DNA, 25 bp, Artificial sequence
  Affy probe set ID: 201261_x_at
cacaaaaccccagggacagcggtct

SEQ ID NO: 3521 - DNA, 25 bp, Artificial sequence
  Affy probe set ID: 201261_x_at
acctgtactgtcccggaggaggttg

SEQ ID NO: 3522 - DNA, 25 bp, Artificial sequence
  Affy probe set ID: 201261_x_at
ctgtcccggaggaggttgggaggtg

SEQ ID NO: 3523 - DNA, 25 bp, Artificial sequence
  Affy probe set ID: 201261_x_at
ttgggaggtggaggcccagcatccc

SEQ ID NO: 3524 - DNA, 25 bp, Artificial sequence
  Affy probe set ID: 201261_x_at
ttatccttctggtccagcgcaagga

SEQ ID NO: 3525 - DNA, 25 bp, Artificial sequence
  Affy probe set ID: 201261_x_at
cttctggtccagcgcaaggaggggc

SEQ ID NO: 3526 - DNA, 25 bp, Artificial sequence
  Affy probe set ID: 201261_x_at
ggtccagcgcaaggaggggctgctt

SEQ ID NO: 3527 - DNA, 25 bp, Artificial sequence
  Affy probe set ID: 201261_x_at
cagcgcaaggaggggctgcttctga

SEQ ID NO: 3528 - DNA, 25 bp, Artificial sequence
  Affy probe set ID: 201261_x_at
tcggtggctgtctttccattaaaga

SEQ ID NO: 3529 - DNA, 25 bp, Artificial sequence
  Affy probe set ID: 201261_x_at
gctgtctttccattaaagaaacacc

SEQ ID NO: 3530 - DNA, 383 bp, Artificial sequence
  Target_Sequence, Fragment of GenBank Accession No. NM_006902
atccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggc

SEQ ID NO: 3531 - DNA, 25 bp, Artificial sequence
  Affy probe set ID: 226695_at
atccaatgtctcaagcaagcaatgt

SEQ ID NO: 3532 - DNA, 25 bp, Artificial sequence
  Affy probe set ID: 226695_at
tagagtaacaagtgctggtcagcca

SEQ ID NO: 3533 - DNA, 25 bp, Artificial sequence
  Affy probe set ID: 226695_at
atacatgttgtacaagctctcaatt

SEQ ID NO: 3534 - DNA, 25 bp, Artificial sequence
  Affy probe set ID: 226695_at
gatgccttctggatcttaagccagt

SEQ ID NO: 3535 - DNA, 25 bp, Artificial sequence
  Affy probe set ID: 226695_at
gccagttgtcagtggaggtcctcag

SEQ ID NO: 3536 - DNA, 25 bp, Artificial sequence
  Affy probe set ID: 226695_at
cctcagggctgcaaatgtcaagaca

SEQ ID NO: 3537 - DNA, 25 bp, Artificial sequence
  Affy probe set ID: 226695_at
tgtcaagacataaccctgttcctca

SEQ ID NO: 3538 - DNA, 25 bp, Artificial sequence
  Affy probe set ID: 226695_at
tgttcctcaccatcatgataccaga

SEQ ID NO: 3539 - DNA, 25 bp, Artificial sequence
  Affy probe set ID: 226695_at
taggaactatctgcctgtgtcctca

SEQ ID NO: 3540 - DNA, 25 bp, Artificial sequence
  Affy probe set ID: 226695_at
tcctcaatctcccttcaaacaagat

SEQ ID NO: 3541 - DNA, 25 bp, Artificial sequence
  Affy probe set ID: 226695_at
gatgctgatttgtagggtacttggc

SEQ ID NO: 3542 - DNA, 365 bp, Artificial sequence
  Target_Sequence, Fragment of GenBank Accession No. NM_000428
gggagccaaggctttatacgtctaaagaaaatattcagtagctgaatccgcccagtgatagcctgtgggcaccagcagcaagggctgccatgggatacagcacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctggg

SEQ ID NO: 3543 - DNA, 25 bp, Artificial sequence
  Affy probe set ID: 204682_at
gggagccaaggctttatacgtctaa

SEQ ID NO: 3544 - DNA, 25 bp, Artificial sequence
  Affy probe set ID: 204682_at
tagctgaatccgcccagtgatagcc

SEQ ID NO: 3545 - DNA, 25 bp, Artificial sequence
  Affy probe set ID: 204682_at
cagtgatagcctgtgggcaccagca

SEQ ID NO: 3546 - DNA, 25 bp, Artificial sequence
  Affy probe set ID: 204682_at
gatacagcacccatctacaaagacc

SEQ ID NO: 3547 - DNA, 25 bp, Artificial sequence
  Affy probe set ID: 204682_at
aaacaaacctcttctgggatctcct

SEQ ID NO: 3548 - DNA, 25 bp, Artificial sequence
  Affy probe set ID: 204682_at
gggatctccttttgtgaaaaccagt

SEQ ID NO: 3549 - DNA, 25 bp, Artificial sequence
  Affy probe set ID: 204682_at
gtgtggtcttgttcagaagcagcca

SEQ ID NO: 3550 - DNA, 25 bp, Artificial sequence
  Affy probe set ID: 204682_at
tgccctttcccttcagaaaacgatg

SEQ ID NO: 3551 - DNA, 25 bp, Artificial sequence
  Affy probe set ID: 204682_at
aacgatggcaggcattcctctgagt

SEQ ID NO: 3552 - DNA, 25 bp, Artificial sequence
  Affy probe set ID: 204682_at
tacaagcagagactcactccaaccc

SEQ ID NO: 3553 - DNA, 25 bp, Artificial sequence
  Affy probe set ID: 204682_at
ctcactccaacccaaactagctggg

SEQ ID NO: 3554 - DNA, 456 bp, Artificial sequence
  Target_Sequence, Fragment of GenBank Accession No. NM_004369
ctccagcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctcaatgttgtgtgtt

SEQ ID NO: 3555 - DNA, 25 bp, Artificial sequence
  Affy probe set ID: 201438_at
ctccagcagttctctcgaatacttt

SEQ ID NO: 3556 - DNA, 25 bp, Artificial sequence
  Affy probe set ID: 201438_at
cagttagccactgctggtgtttatg

SEQ ID NO: 3557 - DNA, 25 bp, Artificial sequence
  Affy probe set ID: 201438_at
ggagtttcatgttatgcctgttgca

SEQ ID NO: 3558 - DNA, 25 bp, Artificial sequence
  Affy probe set ID: 201438_at
aatgcaaatgtcacggctactctat

SEQ ID NO: 3559 - DNA, 25 bp, Artificial sequence
  Affy probe set ID: 201438_at
gctactctatatacttttgcttggt

SEQ ID NO: 3560 - DNA, 25 bp, Artificial sequence
  Affy probe set ID: 201438_at
gggaagcctgtgtatcgtggagaaa

SEQ ID NO: 3561 - DNA, 25 bp, Artificial sequence
  Affy probe set ID: 201438_at
aagagaccaactttttcattccctg

SEQ ID NO: 3562 - DNA, 25 bp, Artificial sequence
  Affy probe set ID: 201438_at
ccccaatttcccagactagatttca

SEQ ID NO: 3563 - DNA, 25 bp, Artificial sequence
  Affy probe set ID: 201438_at
aaaatcccttaatctatgtgcaccg

SEQ ID NO: 3564 - DNA, 25 bp, Artificial sequence
  Affy probe set ID: 201438_at
atgtgcaccgttgggaccaatgcct

SEQ ID NO: 3565 - DNA, 25 bp, Artificial sequence
  Affy probe set ID: 201438_at
ggcattcctctcaatgttgtgtgtt

SEQ ID NO: 3566 - DNA, 446 bp, Artificial sequence
  Target_Sequence, Fragment of GenBank Accession No. NM_000393
tagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctt

SEQ ID NO: 3567 - DNA, 25 bp, Artificial sequence
  Affy probe set ID: 221730_at
tagattccggtatatcgttcttcaa

SEQ ID NO: 3568 - DNA, 25 bp, Artificial sequence
  Affy probe set ID: 221730_at
gttcttcaagacacttgctctaagc

SEQ ID NO: 3569 - DNA, 25 bp, Artificial sequence
  Affy probe set ID: 221730_at
cccatcatagatcttgctcctgtgg

SEQ ID NO: 3570 - DNA, 25 bp, Artificial sequence
  Affy probe set ID: 221730_at
tgctcctgtggatgttggcggcaca

SEQ ID NO: 3571 - DNA, 25 bp, Artificial sequence
  Affy probe set ID: 221730_at
gttggcggcacagaccaggaattcg

SEQ ID NO: 3572 - DNA, 25 bp, Artificial sequence
  Affy probe set ID: 221730_at
aattcggcgttgaaattgggccagt

SEQ ID NO: 3573 - DNA, 25 bp, Artificial sequence
  Affy probe set ID: 221730_at
gacacatcgacaatgagcaccacca

SEQ ID NO: 3574 - DNA, 25 bp, Artificial sequence
  Affy probe set ID: 221730_at
ccaccgccattcacaagaactttga

SEQ ID NO: 3575 - DNA, 25 bp, Artificial sequence
  Affy probe set ID: 221730_at
tgaagttgatcctgagactcttgaa

SEQ ID NO: 3576 - DNA, 25 bp, Artificial sequence
  Affy probe set ID: 221730_at
gactcttgaagtaatggctgatcct

SEQ ID NO: 3577 - DNA, 25 bp, Artificial sequence
  Affy probe set ID: 221730_at
gatgaccaatgacaatgaccacctt

SEQ ID NO: 3578 - DNA, 329 bp, Artificial sequence
  Target_Sequence, Fragment of GenBank Accession No. NM_015419
tccaacctccttcaaattcagtcaccactgttatattaccttctccaggaaccctccagtggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcagtatctggcttgtccatctggtctaaggtggctgcttcttccccagccatgagtcagtttgtgcccatgaataatacacgacctgttatttccatgactgctttactgtattttt

SEQ ID NO: 3579 - DNA, 25 bp, Artificial sequence
  Affy probe set ID: 209596_at
tccaacctccttcaaattcagtcac

SEQ ID NO: 3580 - DNA, 25 bp, Artificial sequence
  Affy probe set ID: 209596_at
ttatattaccttctccaggaaccct

SEQ ID NO: 3581 - DNA, 25 bp, Artificial sequence
  Affy probe set ID: 209596_at
ccctccagtggggaaggctgcgata

SEQ ID NO: 3582 - DNA, 25 bp, Artificial sequence
  Affy probe set ID: 209596_at
ggctgcgatattagatttccttgta

SEQ ID NO: 3583 - DNA, 25 bp, Artificial sequence
  Affy probe set ID: 209596_at
attgaatctagagtcttccccgaaa

SEQ ID NO: 3584 - DNA, 25 bp, Artificial sequence
  Affy probe set ID: 209596_at
ttctctgcagtatctggcttgtcca

SEQ ID NO: 3585 - DNA, 25 bp, Artificial sequence
  Affy probe set ID: 209596_at
ggcttgtccatctggtctaaggtgg

SEQ ID NO: 3586 - DNA, 25 bp, Artificial sequence
  Affy probe set ID: 209596_at
cagccatgagtcagtttgtgcccat

SEQ ID NO: 3587 - DNA, 25 bp, Artificial sequence
  Affy probe set ID: 209596_at
tgcccatgaataatacacgacctgt

SEQ ID NO: 3588 - DNA, 25 bp, Artificial sequence
  Affy probe set ID: 209596_at
cacgacctgttatttccatgactgc

SEQ ID NO: 3589 - DNA, 25 bp, Artificial sequence
  Affy probe set ID: 209596_at
tccatgactgctttactgtattttt

SEQ ID NO: 3590 - DNA, 543 bp, Artificial sequence
  Target_Sequence, Fragment of GenBank Accession No. NM_001102
ggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttac

SEQ ID NO: 3591 - DNA, 25 bp, Artificial sequence
  Affy probe set ID: 208637_x_at
ggtcccgaggagttcaaagcctgcc

SEQ ID NO: 3592 - DNA, 25 bp, Artificial sequence
  Affy probe set ID: 208637_x_at
gcagaatttgcccgcatcatgagca

SEQ ID NO: 3593 - DNA, 25 bp, Artificial sequence
  Affy probe set ID: 208637_x_at
tcatgagcattgtggaccccaaccg

SEQ ID NO: 3594 - DNA, 25 bp, Artificial sequence
  Affy probe set ID: 208637_x_at
tgggggtagtgacattccaggcctt

SEQ ID NO: 3595 - DNA, 25 bp, Artificial sequence
  Affy probe set ID: 208637_x_at
agcagaccaagtcatggcttccttc

SEQ ID NO: 3596 - DNA, 25 bp, Artificial sequence
  Affy probe set ID: 208637_x_at
cttccttcaagatcctggctgggga

SEQ ID NO: 3597 - DNA, 25 bp, Artificial sequence
  Affy probe set ID: 208637_x_at
tacattaccatggacgagctgcgcc

SEQ ID NO: 3598 - DNA, 25 bp, Artificial sequence
  Affy probe set ID: 208637_x_at
ccgaccaggctgagtactgcatcgc

SEQ ID NO: 3599 - DNA, 25 bp, Artificial sequence
  Affy probe set ID: 208637_x_at
aggtgctctggactacatgtccttc

SEQ ID NO: 3600 - DNA, 25 bp, Artificial sequence
  Affy probe set ID: 208637_x_at
ggcgctgtacggcgagagtgacctc

SEQ ID NO: 3601 - DNA, 25 bp, Artificial sequence
  Affy probe set ID: 208637_x_at
ccctgcccgcgaagtgacagtttac

SEQ ID NO: 3602 - DNA, 534 bp, Artificial sequence
  Target_Sequence, Fragment of GenBank Accession No. NM_000877
ggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtact

SEQ ID NO: 3603 - DNA, 25 bp, Artificial sequence
  Affy probe set ID: 202948_at
ggcagctggaatttaaggagggaca

SEQ ID NO: 3604 - DNA, 25 bp, Artificial sequence
  Affy probe set ID: 202948_at
aagtgcaaagttattccccatcttc

SEQ ID NO: 3605 - DNA, 25 bp, Artificial sequence
  Affy probe set ID: 202948_at
ccatcttccaagggttgaattctgg

SEQ ID NO: 3606 - DNA, 25 bp, Artificial sequence
  Affy probe set ID: 202948_at
gaagaagacacattcctagttcccc

SEQ ID NO: 3607 - DNA, 25 bp, Artificial sequence
  Affy probe set ID: 202948_at
cccgtgaacttcctttgacttattg

SEQ ID NO: 3608 - DNA, 25 bp, Artificial sequence
  Affy probe set ID: 202948_at
ttgacttattgtccccactaaaaca

SEQ ID NO: 3609 - DNA, 25 bp, Artificial sequence
  Affy probe set ID: 202948_at
tttcttgcagtttttttatggcatt

SEQ ID NO: 3610 - DNA, 25 bp, Artificial sequence
  Affy probe set ID: 202948_at
aaagatgccctaagtgttgaagaag

SEQ ID NO: 3611 - DNA, 25 bp, Artificial sequence
  Affy probe set ID: 202948_at
aaagcaccaaattcatgtacagcat

SEQ ID NO: 3612 - DNA, 25 bp, Artificial sequence
  Affy probe set ID: 202948_at
catgtacagcatgcatcacggatca

SEQ ID NO: 3613 - DNA, 25 bp, Artificial sequence
  Affy probe set ID: 202948_at
gcatcacggatcaatagactgtact

SEQ ID NO: 3614 - DNA, 396 bp, Artificial sequence
  Target_Sequence, Fragment of GenBank Accession No. NM_015927
ttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagttctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcatt

SEQ ID NO: 3615 - DNA, 25 bp, Artificial sequence
  Affy probe set ID: 209651_at
ttcctgaagctcttcggctgacagc

SEQ ID NO: 3616 - DNA, 25 bp, Artificial sequence
  Affy probe set ID: 209651_at
cgcccctaaggtactatgagttctc

SEQ ID NO: 3617 - DNA, 25 bp, Artificial sequence
  Affy probe set ID: 209651_at
aggtactatgagttctcaggggtca

SEQ ID NO: 3618 - DNA, 25 bp, Artificial sequence
  Affy probe set ID: 209651_at
cccacacgcccacaaagtggattgc

SEQ ID NO: 3619 - DNA, 25 bp, Artificial sequence
  Affy probe set ID: 209651_at
acgcccacaaagtggattgcacaca

SEQ ID NO: 3620 - DNA, 25 bp, Artificial sequence
  Affy probe set ID: 209651_at
ctcactgttctgtgcactttttcta

SEQ ID NO: 3621 - DNA, 25 bp, Artificial sequence
  Affy probe set ID: 209651_at
tcactgttctgtgcactttttctac

SEQ ID NO: 3622 - DNA, 25 bp, Artificial sequence
  Affy probe set ID: 209651_at
ctgtgcactttttctacctacataa

SEQ ID NO: 3623 - DNA, 25 bp, Artificial sequence
  Affy probe set ID: 209651_at
gtgcactttttctacctacataaac

SEQ ID NO: 3624 - DNA, 25 bp, Artificial sequence
  Affy probe set ID: 209651_at
gcactttttctacctacataaacac

SEQ ID NO: 3625 - DNA, 25 bp, Artificial sequence
  Affy probe set ID: 209651_at
ttctacctacataaacacacgcatt

SEQ ID NO: 3626 - DNA, 511 bp, Artificial sequence
  Target_Sequence, Fragment of GenBank Accession No. NM_032772
  misc_feature (205)..(205): n is a, c, g, or t
  misc_feature (216)..(216): n is a, c, g, or t
  misc_feature (232)..(232): n is a, c, g, or t
  misc_feature (260)..(260): n is a, c, g, or t
  misc_feature (378)..(378): n is a, c, g, or t
  misc_feature (390)..(390): n is a, c, g, or t
gtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatangaaaaaaaaanggaaaaaataattgangaaagtgttcatctgaggactgcatcgngtggacactggtatttatttatgttagctccaagcggaccggtggttcaaaagtgcattatttagtttgagctctgtaggtaaaaaggaggtgggaaaaattttaaaacttgagggtnaaaatgtggaanacaaaccctcccatcccttgtagattataaataaaagcaaaaccgccacagaactagaggtcttctctttaatgttactttaaaattgctatgattgtattgtacgttatttaatgtctga

SEQ ID NO: 3627 - DNA, 25 bp, Artificial sequence
  Affy probe set ID: 227195_at
gtccagggagaggcgggatcacggc

SEQ ID NO: 3628 - DNA, 25 bp, Artificial sequence
  Affy probe set ID: 227195_at
gaggactcgggccacgaaaggaaag

SEQ ID NO: 3629 - DNA, 25 bp, Artificial sequence
  Affy probe set ID: 227195_at
tgtataccgtatctatctacccgac

SEQ ID NO: 3630 - DNA, 25 bp, Artificial sequence
  Affy probe set ID: 227195_at
ttatgttagctccaagcggaccggt

SEQ ID NO: 3631 - DNA, 25 bp, Artificial sequence
  Affy probe set ID: 227195_at
tagctccaagcggaccggtggttca

SEQ ID NO: 3632 - DNA, 25 bp, Artificial sequence
  Affy probe set ID: 227195_at
ggaccggtggttcaaaagtgcatta

SEQ ID NO: 3633 - DNA, 25 bp, Artificial sequence
  Affy probe set ID: 227195_at
aagtgcattatttagtttgagctct

SEQ ID NO: 3634 - DNA, 25 bp, Artificial sequence
  Affy probe set ID: 227195_at
cctcccatcccttgtagattataaa

SEQ ID NO: 3635 - DNA, 25 bp, Artificial sequence
  Affy probe set ID: 227195_at
aaccgccacagaactagaggtcttc

SEQ ID NO: 3636 - DNA, 25 bp, Artificial sequence
  Affy probe set ID: 227195_at
gaggtcttctctttaatgttacttt

SEQ ID NO: 3637 - DNA, 25 bp, Artificial sequence
  Affy probe set ID: 227195_at
gtattgtacgttatttaatgtctga

SEQ ID NO: 3638 - DNA, 554 bp, Artificial sequence
  Target_Sequence, Fragment of GenBank Accession No. NM_020440
  misc_feature (397)..(397): n is a, c, g, or t
tgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgntgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttt

SEQ ID NO: 3639 - DNA, 25 bp, Artificial sequence
  Affy probe set ID: 224937_at
tgactcaccaactgggctaaatttt

SEQ ID NO: 3640 - DNA, 25 bp, Artificial sequence
  Affy probe set ID: 224937_at
ccatctgaggggctccctgagatct

SEQ ID NO: 3641 - DNA, 25 bp, Artificial sequence
  Affy probe set ID: 224937_at
gcagccatgattttgtcactgacat

SEQ ID NO: 3642 - DNA, 25 bp, Artificial sequence
  Affy probe set ID: 224937_at
cactgacatctgtgagccaaagact

SEQ ID NO: 3643 - DNA, 25 bp, Artificial sequence
  Affy probe set ID: 224937_at
tactacacaacttgctactttcaga

SEQ ID NO: 3644 - DNA, 25 bp, Artificial sequence
  Affy probe set ID: 224937_at
cttttttttagcttcaccgatgaca

SEQ ID NO: 3645 - DNA, 25 bp, Artificial sequence
  Affy probe set ID: 224937_at
ggatttgggtaagttctcctccact

SEQ ID NO: 3646 - DNA, 25 bp, Artificial sequence
  Affy probe set ID: 224937_at
tgtgtgcagatccctagaagagaaa

SEQ ID NO: 3647 - DNA, 25 bp, Artificial sequence
  Affy probe set ID: 224937_at
aagtgtggcacataaggatctgcag

SEQ ID NO: 3648 - DNA, 25 bp, Artificial sequence
  Affy probe set ID: 224937_at
ggatctgcagaattttccgtagaca

SEQ ID NO: 3649 - DNA, 25 bp, Artificial sequence
  Affy probe set ID: 224937_at
attatgcaatgcaccatttgttttt

SEQ ID NO: 3650 - DNA, 542 bp, Artificial sequence
  Target_Sequence, Fragment of GenBank Accession No. NM_000138
  misc_feature (69)..(69): n is a, c, g, or t
  misc_feature (210)..(211): n is a, c, g, or t
tcaatgaatgtggctctgcgcaggccccctgcagctatggctgttccaataccgagggcggttacctgngtggctgtccacctggttacttccgcataggccaagggcactgtgtttctggaatgggcatgggccgaggaaacccagagccacctgtcagtggtgaaatggatgacaattcactctccccagaggcttgttacgagtgtnngatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcatta

SEQ ID NO: 3651 - DNA, 25 bp, Artificial sequence
  Affy probe set ID: 202765_s_at
tcaatgaatgtggctctgcgcaggc

SEQ ID NO: 3652 - DNA, 25 bp, Artificial sequence
  Affy probe set ID: 202765_s_at
gcagctatggctgttccaataccga

SEQ ID NO: 3653 - DNA, 25 bp, Artificial sequence
  Affy probe set ID: 202765_s_at
acttccgcataggccaagggcactg

SEQ ID NO: 3654 - DNA, 25 bp, Artificial sequence
  Affy probe set ID: 202765_s_at
aagggcactgtgtttctggaatggg

SEQ ID NO: 3655 - DNA, 25 bp, Artificial sequence
  Affy probe set ID: 202765_s_at
aatggatgacaattcactctcccca

SEQ ID NO: 3656 - DNA, 25 bp, Artificial sequence
  Affy probe set ID: 202765_s_at
ctctccccagaggcttgttacgagt

SEQ ID NO: 3657 - DNA, 25 bp, Artificial sequence
  Affy probe set ID: 202765_s_at
caaacgaaactgatgcctccaatat

SEQ ID NO: 3658 - DNA, 25 bp, Artificial sequence
  Affy probe set ID: 202765_s_at
gaagacagccatctttgctttcaat

SEQ ID NO: 3659 - DNA, 25 bp, Artificial sequence
  Affy probe set ID: 202765_s_at
tttcaatatttcccacgtcagtaac

SEQ ID NO: 3660 - DNA, 25 bp, Artificial sequence
  Affy probe set ID: 202765_s_at
cttccagctcttacaactctgacga

SEQ ID NO: 3661 - DNA, 25 bp, Artificial sequence
  Affy probe set ID: 202765_s_at
gccagtggctggaacctattcatta

SEQ ID NO: 3662 - DNA, 501 bp, Artificial sequence
  Target_Sequence, Fragment of GenBank Accession No. NM_031442
gcagggctagttattccgatttcttgcacaattatttagctttttgtaagttcaacatgtaaattttaaagacataaatatagagagacttatgtgtttgaatataaatgatatatatggattagcatgtacctgtatattattaaacatgcaatgaactgactggtaagtgacgtctaattgtatggctagcaatgtaatttattcagactgtatttttgtacagagcagtgcactctaacctatgcctctgtgtcctctttaatgcctaaagctgtgcctagaaatttcatctgtcttaaaagtaaaatatacttcatgctgtttatgctattagtttctgtactgctattctatatttattatttttaaatatatgacatgtttactacttaaacatgaattcatggtatcctggttattttttttaagtcatctgggggaaaacctgtttatcactccagtgattttgagtttgcagtttcacaatcagttcttcat

SEQ ID NO: 3663 - DNA, 25 bp, Artificial sequence
  Affy probe set ID: 209656_s_at
gcagggctagttattccgatttctt

SEQ ID NO: 3664 - DNA, 25 bp, Artificial sequence
  Affy probe set ID: 209656_s_at
gttattccgatttcttgcacaatta

SEQ ID NO: 3665 - DNA, 25 bp, Artificial sequence
  Affy probe set ID: 209656_s_at
atggattagcatgtacctgtatatt

SEQ ID NO: 3666 - DNA, 25 bp, Artificial sequence
  Affy probe set ID: 209656_s_at
gtgacgtctaattgtatggctagca

SEQ ID NO: 3667 - DNA, 25 bp, Artificial sequence
  Affy probe set ID: 209656_s_at
agagcagtgcactctaacctatgcc

SEQ ID NO: 3668 - DNA, 25 bp, Artificial sequence
  Affy probe set ID: 209656_s_at
tctgtgtcctctttaatgcctaaag

SEQ ID NO: 3669 - DNA, 25 bp, Artificial sequence
  Affy probe set ID: 209656_s_at
gctgtgcctagaaatttcatctgtc

SEQ ID NO: 3670 - DNA, 25 bp, Artificial sequence
  Affy probe set ID: 209656_s_at
gtttctgtactgctattctatattt

SEQ ID NO: 3671 - DNA, 25 bp, Artificial sequence
  Affy probe set ID: 209656_s_at
gaattcatggtatcctggttatttt

SEQ ID NO: 3672 - DNA, 25 bp, Artificial sequence
  Affy probe set ID: 209656_s_at
gaaaacctgtttatcactccagtga

SEQ ID NO: 3673 - DNA, 25 bp, Artificial sequence
  Affy probe set ID: 209656_s_at
tgcagtttcacaatcagttcttcat

SEQ ID NO: 3674 - DNA, 509 bp, Artificial sequence
  Target_Sequence, Fragment of GenBank Accession No. NM_001734
tgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactccttt

SEQ ID NO: 3675 - DNA, 25 bp, Artificial sequence
  Affy probe set ID: 208747_s_at
tgcagaggcctatgttttcactcct

SEQ ID NO: 3676 - DNA, 25 bp, Artificial sequence
  Affy probe set ID: 208747_s_at
gcctttgctgtacaggatcccaatg

SEQ ID NO: 3677 - DNA, 25 bp, Artificial sequence
  Affy probe set ID: 208747_s_at
agaccaaattctacgcagctggcct

SEQ ID NO: 3678 - DNA, 25 bp, Artificial sequence
  Affy probe set ID: 208747_s_at
tgtgggacctatgggctctacacac

SEQ ID NO: 3679 - DNA, 25 bp, Artificial sequence
  Affy probe set ID: 208747_s_at
tatgcaggaaaatagcaccccccgt

SEQ ID NO: 3680 - DNA, 25 bp, Artificial sequence
  Affy probe set ID: 208747_s_at
gggtggtgaccaatgcattaccttc

SEQ ID NO: 3681 - DNA, 25 bp, Artificial sequence
  Affy probe set ID: 208747_s_at
gcattaccttctgttccttatgata

SEQ ID NO: 3682 - DNA, 25 bp, Artificial sequence
  Affy probe set ID: 208747_s_at
ttgattgttgagacgccttgctaga

SEQ ID NO: 3683 - DNA, 25 bp, Artificial sequence
  Affy probe set ID: 208747_s_at
acatttgtggtctgactccttgggg

SEQ ID NO: 3684 - DNA, 25 bp, Artificial sequence
  Affy probe set ID: 208747_s_at
tttccccggagtacctattgtagat

SEQ ID NO: 3685 - DNA, 25 bp, Artificial sequence
  Affy probe set ID: 208747_s_at
aacactatgggtggggcactccttt

SEQ ID NO: 3686 - DNA, 497 bp, Artificial sequence
  Target_Sequence, Fragment of GenBank Accession No. NM_002290
gacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagaggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttctttttagcccttttgtttggtctatcagta

SEQ ID NO: 3687 - DNA, 25 bp, Artificial sequence
  Affy probe set ID: 202202_s_at
gacagagcacagctgcccaaataca

SEQ ID NO: 3688 - DNA, 25 bp, Artificial sequence
  Affy probe set ID: 202202_s_at
acagctgcccaaatacaaagttctt

SEQ ID NO: 3689 - DNA, 25 bp, Artificial sequence
  Affy probe set ID: 202202_s_at
gaggaacagtaactcttccttcggg

SEQ ID NO: 3690 - DNA, 25 bp, Artificial sequence
  Affy probe set ID: 202202_s_at
cgggtggaagctttcatcgagttga

SEQ ID NO: 3691 - DNA, 25 bp, Artificial sequence
  Affy probe set ID: 202202_s_at
ggacttaaacgaatcatcagggacc

SEQ ID NO: 3692 - DNA, 25 bp, Artificial sequence
  Affy probe set ID: 202202_s_at
gggaccggatatttcttatttctca

SEQ ID NO: 3693 - DNA, 25 bp, Artificial sequence
  Affy probe set ID: 202202_s_at
taaccttgaatccaaagtgtctgca

SEQ ID NO: 3694 - DNA, 25 bp, Artificial sequence
  Affy probe set ID: 202202_s_at
acttacttgtattgagagcacacgc

SEQ ID NO: 3695 - DNA, 25 bp, Artificial sequence
  Affy probe set ID: 202202_s_at
agcacacgcaattcctactggtgaa

SEQ ID NO: 3696 - DNA, 25 bp, Artificial sequence
  Affy probe set ID: 202202_s_at
gcggctagattctcagattcacctt

SEQ ID NO: 3697 - DNA, 25 bp, Artificial sequence
  Affy probe set ID: 202202_s_at
agcccttttgtttggtctatcagta

SEQ ID NO: 3698 - DNA, 120 bp, Artificial sequence
  Target_Sequence, Fragment of GenBank Accession No. CN312045
  misc_feature (43)..(43): n is a, c, g, or t
cctttccgtttctgtctatgatgtaggcttctgaggagaaccnagaagcttggctttagtggtagaatgacagaacttagggatcccttgcaggctagaacaaagttctgacccttagac

SEQ ID NO: 3699 - DNA, 25 bp, Artificial sequence
  Affy probe set ID: 222288_at
cctttccgtttctgtctatgatgta

SEQ ID NO: 3700 - DNA, 25 bp, Artificial sequence
  Affy probe set ID: 222288_at
ttccgtttctgtctatgatgtaggc

SEQ ID NO: 3701 - DNA, 25 bp, Artificial sequence
  Affy probe set ID: 222288_at
gtttctgtctatgatgtaggcttct

SEQ ID NO: 3702 - DNA, 25 bp, Artificial sequence
  Affy probe set ID: 222288_at
tgtctatgatgtaggcttctgagga

SEQ ID NO: 3703 - DNA, 25 bp, Artificial sequence
  Affy probe set ID: 222288_at
gaagcttggctttagtggtagaatg

SEQ ID NO: 3704 - DNA, 25 bp, Artificial sequence
  Affy probe set ID: 222288_at
ttggctttagtggtagaatgacaga

SEQ ID NO: 3705 - DNA, 25 bp, Artificial sequence
  Affy probe set ID: 222288_at
gaatgacagaacttagggatccctt

SEQ ID NO: 3706 - DNA, 25 bp, Artificial sequence
  Affy probe set ID: 222288_at
gacagaacttagggatcccttgcag

SEQ ID NO: 3707 - DNA, 25 bp, Artificial sequence
  Affy probe set ID: 222288_at
gggatcccttgcaggctagaacaaa

SEQ ID NO: 3708 - DNA, 25 bp, Artificial sequence
  Affy probe set ID: 222288_at
gatcccttgcaggctagaacaaagt

SEQ ID NO: 3709 - DNA, 25 bp, Artificial sequence
  Affy probe set ID: 222288_at
tagaacaaagttctgacccttagac

SEQ ID NO: 3710 - DNA, 474 bp, Artificial sequence
  Target_Sequence, Fragment of GenBank Accession No. NM_000089
aacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtt

SEQ ID NO: 3711 - DNA, 25 bp, Artificial sequence
  Affy probe set ID: 202403_s_at
aacctgaaaacatcccagccaagaa

SEQ ID NO: 3712 - DNA, 25 bp, Artificial sequence
  Affy probe set ID: 202403_s_at
gagaaactatcaatgctggcagcca

SEQ ID NO: 3713 - DNA, 25 bp, Artificial sequence
  Affy probe set ID: 202403_s_at
ggaaatggctacccaacttgccttc

SEQ ID NO: 3714 - DNA, 25 bp, Artificial sequence
  Affy probe set ID: 202403_s_at
aactatgcctctcagaacatcacct

SEQ ID NO: 3715 - DNA, 25 bp, Artificial sequence
  Affy probe set ID: 202403_s_at
aaggctgtcattctacagggctcta

SEQ ID NO: 3716 - DNA, 25 bp, Artificial sequence
  Affy probe set ID: 202403_s_at
gagggcaacagcaggttcacttaca

SEQ ID NO: 3717 - DNA, 25 bp, Artificial sequence
  Affy probe set ID: 202403_s_at
gcaggttcacttacactgttcttgt

SEQ ID NO: 3718 - DNA, 25 bp, Artificial sequence
  Affy probe set ID: 202403_s_at
aaacaaataagccatcacgcctgcc

SEQ ID NO: 3719 - DNA, 25 bp, Artificial sequence
  Affy probe set ID: 202403_s_at
cccttccttgatattgcacctttgg

SEQ ID NO: 3720 - DNA, 25 bp, Artificial sequence
  Affy probe set ID: 202403_s_at
ctttggacatcggtggtgctgacca

SEQ ID NO: 3721 - DNA, 25 bp, Artificial sequence
  Affy probe set ID: 202403_s_at
tttgtggacattggcccagtctgtt

SEQ ID NO: 3722 - DNA, 525 bp, Artificial sequence
  Target_Sequence, Fragment of GenBank Accession No. NM_004530
ctcagagccacccctaaagagatcctttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaat

SEQ ID NO: 3723 - DNA, 25 bp, Artificial sequence
  Affy probe set ID: 201069_at
ctcagagccacccctaaagagatcc

SEQ ID NO: 3724 - DNA, 25 bp, Artificial sequence
  Affy probe set ID: 201069_at
ggagactgtctcaagagggcactgg

SEQ ID NO: 3725 - DNA, 25 bp, Artificial sequence
  Affy probe set ID: 201069_at
caagagggcactggtggcccgacag

SEQ ID NO: 3726 - DNA, 25 bp, Artificial sequence
  Affy probe set ID: 201069_at
ttcactgctggctgccttagaacct

SEQ ID NO: 3727 - DNA, 25 bp, Artificial sequence
  Affy probe set ID: 201069_at
acctttcttacattagcagtttgct

SEQ ID NO: 3728 - DNA, 25 bp, Artificial sequence
  Affy probe set ID: 201069_at
gctttgtatgcactttgtttttttc

SEQ ID NO: 3729 - DNA, 25 bp, Artificial sequence
  Affy probe set ID: 201069_at
tcaggttgtctgaagtcactgcaca

SEQ ID NO: 3730 - DNA, 25 bp, Artificial sequence
  Affy probe set ID: 201069_at
cagcccacatagtgatggttcccct

SEQ ID NO: 3731 - DNA, 25 bp, Artificial sequence
  Affy probe set ID: 201069_at
cctgttcactctacttagcatgtcc

SEQ ID NO: 3732 - DNA, 25 bp, Artificial sequence
  Affy probe set ID: 201069_at
cgagtctcttctccactggatggag

SEQ ID NO: 3733 - DNA, 25 bp, Artificial sequence
  Affy probe set ID: 201069_at
ccttcaaccattccccatgggaaat

SEQ ID NO: 3734 - DNA, 481 bp, Artificial sequence
  Target_Sequence, Fragment of GenBank Accession No. NM_001387
tgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtga

SEQ ID NO: 3735 - DNA, 25 bp, Artificial sequence
  Affy probe set ID: 201431_s_at
tgagggccacgggcttgggtagtgg

SEQ ID NO: 3736 - DNA, 25 bp, Artificial sequence
  Affy probe set ID: 201431_s_at
tgggtttacttcaaaatccctcagc

SEQ ID NO: 3737 - DNA, 25 bp, Artificial sequence
  Affy probe set ID: 201431_s_at
cttgttcttcacgactgtctatact

SEQ ID NO: 3738 - DNA, 25 bp, Artificial sequence
  Affy probe set ID: 201431_s_at
gagtgtcatgtttccacaaagggct

SEQ ID NO: 3739 - DNA, 25 bp, Artificial sequence
  Affy probe set ID: 201431_s_at
gacacctgagcctggattttcactc

SEQ ID NO: 3740 - DNA, 25 bp, Artificial sequence
  Affy probe set ID: 201431_s_at
gattttcactcatccctgagaagcc

SEQ ID NO: 3741 - DNA, 25 bp, Artificial sequence
  Affy probe set ID: 201431_s_at
gagaagccctttccagtagggtggg

SEQ ID NO: 3742 - DNA, 25 bp, Artificial sequence
  Affy probe set ID: 201431_s_at
tagggtgggcaattcccaacttcct

SEQ ID NO: 3743 - DNA, 25 bp, Artificial sequence
  Affy probe set ID: 201431_s_at
gccagcattcattgtaagttccctc

SEQ ID NO: 3744 - DNA, 25 bp, Artificial sequence
  Affy probe set ID: 201431_s_at
gtaatctcctgtgatctgtgctagc

SEQ ID NO: 3745 - DNA, 25 bp, Artificial sequence
  Affy probe set ID: 201431_s_at
gctgtgaggcagctctggaacgtga

SEQ ID NO: 3746 - DNA, 415 bp, Artificial sequence
  Target_Sequence, Fragment of GenBank Accession No. NM_138389
taaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcat

SEQ ID NO: 3747 - DNA, 25 bp, Artificial sequence
  Affy probe set ID: 213455_at
taaaatcgcctcacagatcacactc

SEQ ID NO: 3748 - DNA, 25 bp, Artificial sequence
  Affy probe set ID: 213455_at
gatcacactcgctggtggcaaatat

SEQ ID NO: 3749 - DNA, 25 bp, Artificial sequence
  Affy probe set ID: 213455_at
atgggaggctgcacagaagaccctg

SEQ ID NO: 3750 - DNA, 25 bp, Artificial sequence
  Affy probe set ID: 213455_at
caggaggggcattgtcagtggctgc

SEQ ID NO: 3751 - DNA, 25 bp, Artificial sequence
  Affy probe set ID: 213455_at
cccatggacatccctacaggtactg

SEQ ID NO: 3752 - DNA, 25 bp, Artificial sequence
  Affy probe set ID: 213455_at
ggtactgtcatgtgaagccttgcct

SEQ ID NO: 3753 - DNA, 25 bp, Artificial sequence
  Affy probe set ID: 213455_at
tgaagccttgcctagtagttctctc

SEQ ID NO: 3754 - DNA, 25 bp, Artificial sequence
  Affy probe set ID: 213455_at
aaacctcttattcacatttgctttg

SEQ ID NO: 3755 - DNA, 25 bp, Artificial sequence
  Affy probe set ID: 213455_at
tttgctttgattccccgatggagta

SEQ ID NO: 3756 - DNA, 25 bp, Artificial sequence
  Affy probe set ID: 213455_at
agtagactgcctttgttccatacag

SEQ ID NO: 3757 - DNA, 25 bp, Artificial sequence
  Affy probe set ID: 213455_at
atatcatcctacttcttattagcat

SEQ ID NO: 3758 - DNA, 542 bp, Artificial sequence
  Target_Sequence, Fragment of GenBank Accession No. NM_006670
aggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactga

SEQ ID NO: 3759 - DNA, 25 bp, Artificial sequence
  Affy probe set ID: 203476_at
aggggatttgcttccttgttatgta

SEQ ID NO: 3760 - DNA, 25 bp, Artificial sequence
  Affy probe set ID: 203476_at
aagtttctcggtgtgttctgttaat

SEQ ID NO: 3761 - DNA, 25 bp, Artificial sequence
  Affy probe set ID: 203476_at
gtgtatagtgttttaccctcttctt

SEQ ID NO: 3762 - DNA, 25 bp, Artificial sequence
  Affy probe set ID: 203476_at
ggagggatttttcaggtttcagcat

SEQ ID NO: 3763 - DNA, 25 bp, Artificial sequence
  Affy probe set ID: 203476_at
ctgtctctctctcagtacagttcaa

SEQ ID NO: 3764 - DNA, 25 bp, Artificial sequence
  Affy probe set ID: 203476_at
gtacccacacagatagcattcaaca

SEQ ID NO: 3765 - DNA, 25 bp, Artificial sequence
  Affy probe set ID: 203476_at
gcatcctataaactgcctgcagacg

SEQ ID NO: 3766 - DNA, 25 bp, Artificial sequence
  Affy probe set ID: 203476_at
tgcagacgttagcaggctcttcaaa

SEQ ID NO: 3767 - DNA, 25 bp, Artificial sequence
  Affy probe set ID: 203476_at
ggagcacctgcatccaagagcatgc

SEQ ID NO: 3768 - DNA, 25 bp, Artificial sequence
  Affy probe set ID: 203476_at
taacttgcaacttcataacttcttt

SEQ ID NO: 3769 - DNA, 25 bp, Artificial sequence
  Affy probe set ID: 203476_at
actgcatcgagatccaaccgactga

SEQ ID NO: 3770 - DNA, 534 bp, Artificial sequence
  Target_Sequence, Fragment of GenBank Accession No. NM_000304
tgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgt

SEQ ID NO: 3771 - DNA, 25 bp, Artificial sequence
  Affy probe set ID: 210139_s_at
tgtgaagctttacgcgcacacggac

SEQ ID NO: 3772 - DNA, 25 bp, Artificial sequence
  Affy probe set ID: 210139_s_at
gtggcattggcatacttgcccttac

SEQ ID NO: 3773 - DNA, 25 bp, Artificial sequence
  Affy probe set ID: 210139_s_at
tggagtatcttcgtcacacatctaa

SEQ ID NO: 3774 - DNA, 25 bp, Artificial sequence
  Affy probe set ID: 210139_s_at
ggatttaccattccttattatcact

SEQ ID NO: 3775 - DNA, 25 bp, Artificial sequence
  Affy probe set ID: 210139_s_at
aactgcttttgtacctagctaggct

SEQ ID NO: 3776 - DNA, 25 bp, Artificial sequence
  Affy probe set ID: 210139_s_at
aatcataaagccttcatcactccca

SEQ ID NO: 3777 - DNA, 25 bp, Artificial sequence
  Affy probe set ID: 210139_s_at
aacaagcgtctagactccttgggac

SEQ ID NO: 3778 - DNA, 25 bp, Artificial sequence
  Affy probe set ID: 210139_s_at
gaccgtgagttcctagagcttggct

SEQ ID NO: 3779 - DNA, 25 bp, Artificial sequence
  Affy probe set ID: 210139_s_at
tgtgcctccaaggactgtctggcaa

SEQ ID NO: 3780 - DNA, 25 bp, Artificial sequence
  Affy probe set ID: 210139_s_at
atatggtgcccttctgatgctaaga

SEQ ID NO: 3781 - DNA, 25 bp, Artificial sequence
  Affy probe set ID: 210139_s_at
gatgctaagactccagaccttttgt

SEQ ID NO: 3782 - DNA, 449 bp, Artificial sequence
  Target_Sequence, Fragment of GenBank Accession No. NM_002775
ctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctctttt

SEQ ID NO: 3783 - DNA, 25 bp, Artificial sequence
  Affy probe set ID: 201185_at
ctcaaagactctcccgtggatgacg

SEQ ID NO: 3784 - DNA, 25 bp, Artificial sequence
  Affy probe set ID: 201185_at
ggactctgggctgctggaataggac

SEQ ID NO: 3785 - DNA, 25 bp, Artificial sequence
  Affy probe set ID: 201185_at
ggacactcaagacttttgactgcca

SEQ ID NO: 3786 - DNA, 25 bp, Artificial sequence
  Affy probe set ID: 201185_at
ttcagtggagactccctggccaaca

SEQ ID NO: 3787 - DNA, 25 bp, Artificial sequence
  Affy probe set ID: 201185_at
tatgcagtgtgctttttcttgccag

SEQ ID NO: 3788 - DNA, 25 bp, Artificial sequence
  Affy probe set ID: 201185_at
tgggccattcttgcttagacagtca

SEQ ID NO: 3789 - DNA, 25 bp, Artificial sequence
  Affy probe set ID: 201185_at
tgtctcctcctttaactgagtcatc

SEQ ID NO: 3790 - DNA, 25 bp, Artificial sequence
  Affy probe set ID: 201185_at
atagaagaagccccacgggagccag

SEQ ID NO: 3791 - DNA, 25 bp, Artificial sequence
  Affy probe set ID: 201185_at
gatgggactggtcgtgtttgtgctt

SEQ ID NO: 3792 - DNA, 25 bp, Artificial sequence
  Affy probe set ID: 201185_at
tgtgcttttctccaagtcagcaccc

SEQ ID NO: 3793 - DNA, 25 bp, Artificial sequence
  Affy probe set ID: 201185_at
tcaaacggccgaagttgcctctttt

SEQ ID NO: 3794 - DNA, 488 bp, Artificial sequence
  Target_Sequence, Fragment of GenBank Accession No. NM_002593
actgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccaactccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgc

SEQ ID NO: 3795 - DNA, 25 bp, Artificial sequence
  Affy probe set ID: 202465_at
actgagcctaaagtcaagctgcccc

SEQ ID NO: 3796 - DNA, 25 bp, Artificial sequence
  Affy probe set ID: 202465_at
caaagcagtgccgccggacaggcac

SEQ ID NO: 3797 - DNA, 25 bp, Artificial sequence
  Affy probe set ID: 202465_at
gacaggcaccttgcagagcaacttc

SEQ ID NO: 3798 - DNA, 25 bp, Artificial sequence
  Affy probe set ID: 202465_at
agtccatggttcgggagccagggga

SEQ ID NO: 3799 - DNA, 25 bp, Artificial sequence
  Affy probe set ID: 202465_at
gactgtcagtcttattggtgcttat

SEQ ID NO: 3800 - DNA, 25 bp, Artificial sequence
  Affy probe set ID: 202465_at
tccctgaagttttacgtgccttgca

SEQ ID NO: 3801 - DNA, 25 bp, Artificial sequence
  Affy probe set ID: 202465_at
gttatctgctgatgggccaggtaga

SEQ ID NO: 3802 - DNA, 25 bp, Artificial sequence
  Affy probe set ID: 202465_at
agaagagaacagaggccccgtcctt

SEQ ID NO: 3803 - DNA, 25 bp, Artificial sequence
  Affy probe set ID: 202465_at
cagagagctttgtggttctccaccg

SEQ ID NO: 3804 - DNA, 25 bp, Artificial sequence
  Affy probe set ID: 202465_at
agcaagaggaagtgcccctctcaac

SEQ ID NO: 3805 - DNA, 25 bp, Artificial sequence
  Affy probe set ID: 202465_at
ctgctgcgtcccaggactgagacgc

SEQ ID NO: 3806 - DNA, 426 bp, Artificial sequence
  Target_Sequence, Fragment of GenBank Accession No. NM_003118
  misc_feature (324)..(324): n is a, c, g, or t
caggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactncccttagagatagagaaacagacccaagaaatgtgctcaattgcaatgggccacatacctagatctccagatgtcatttcccctctcttattttaagttatg

SEQ ID NO: 3807 - DNA, 25 bp, Artificial sequence
  Affy probe set ID: 212667_at
caggaggacacagcattattctagt

SEQ ID NO: 3808 - DNA, 25 bp, Artificial sequence
  Affy probe set ID: 212667_at
tattctagtgctgtactgttccgta

SEQ ID NO: 3809 - DNA, 25 bp, Artificial sequence
  Affy probe set ID: 212667_at
tgctgtactgttccgtacggcagcc

SEQ ID NO: 3810 - DNA, 25 bp, Artificial sequence
  Affy probe set ID: 212667_at
cccaatcacactagcaacatttcaa

SEQ ID NO: 3811 - DNA, 25 bp, Artificial sequence
  Affy probe set ID: 212667_at
gaagtagaatcttttcatcatcaca

SEQ ID NO: 3812 - DNA, 25 bp, Artificial sequence
  Affy probe set ID: 212667_at
ggacagtgctcttctagatcatcat

SEQ ID NO: 3813 - DNA, 25 bp, Artificial sequence
  Affy probe set ID: 212667_at
gatcatcataagactacagagcact

SEQ ID NO: 3814 - DNA, 25 bp, Artificial sequence
  Affy probe set ID: 212667_at
ttcaaagctcatgcatgttcatcat

SEQ ID NO: 3815 - DNA, 25 bp, Artificial sequence
  Affy probe set ID: 212667_at
atgttcatcatgttagtgtcgtatt

SEQ ID NO: 3816 - DNA, 25 bp, Artificial sequence
  Affy probe set ID: 212667_at
tagtgtcgtattttgagctggggtt

SEQ ID NO: 3817 - DNA, 25 bp, Artificial sequence
  Affy probe set ID: 212667_at
ttcccctctcttattttaagttatg

SEQ ID NO: 3818 - DNA, 542 bp, Artificial sequence
  Target_Sequence, Fragment of GenBank Accession No. NM_007085
actcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttcct

SEQ ID NO: 3819 - DNA, 25 bp, Artificial sequence
  Affy probe set ID: 208782_at
actcccaagagcaaatccacattcc

SEQ ID NO: 3820 - DNA, 25 bp, Artificial sequence
  Affy probe set ID: 208782_at
tcttgagttctgcagcttctgtgta

SEQ ID NO: 3821 - DNA, 25 bp, Artificial sequence
  Affy probe set ID: 208782_at
tagggcagctgtcgtctatgccgta

SEQ ID NO: 3822 - DNA, 25 bp, Artificial sequence
  Affy probe set ID: 208782_at
aatagcctagtctggggagtcttcc

SEQ ID NO: 3823 - DNA, 25 bp, Artificial sequence
  Affy probe set ID: 208782_at
ttccttcagccctctaaaagcatag

SEQ ID NO: 3824 - DNA, 25 bp, Artificial sequence
  Affy probe set ID: 208782_at
gcatagggcttagcctgcaggcttc

SEQ ID NO: 3825 - DNA, 25 bp, Artificial sequence
  Affy probe set ID: 208782_at
catggaaacattcccacatgccgtg

SEQ ID NO: 3826 - DNA, 25 bp, Artificial sequence
  Affy probe set ID: 208782_at
acatgccgtgactctggactatatc

SEQ ID NO: 3827 - DNA, 25 bp, Artificial sequence
  Affy probe set ID: 208782_at
ttggaaagcagggttcctctgcctg

SEQ ID NO: 3828 - DNA, 25 bp, Artificial sequence
  Affy probe set ID: 208782_at
gtctgaatgtctttcctttacacct

SEQ ID NO: 3829 - DNA, 25 bp, Artificial sequence
  Affy probe set ID: 208782_at
gtttttgtaactcctgattcttcct

SEQ ID NO: 3830 - DNA, 400 bp, Artificial sequence
  Target_Sequence, Fragment of GenBank Accession No. NM_001080393
  misc_feature (352)..(353): n is a, c, g, or t
gaggctgagcatgaaggtgtgtctgttctgcatggaaaccgaggcgtctaccatgacgataagcaaccaacgttcagagcactctatgaagcaatacgggattttccctttcaagacaatctctttcaatccatgtattacccccttcagctgaagtttttggagactgtgcacactttatgtggacgaatcccgcaagtttttctgaagcaaattgagaaaacaatgaaaagggcttatgagaaacacgtcatcatccatgttggccccaaccagatgcactgaatattttgtcttgttgcaagtcaattaggtgtcttgtgaacaaggaaatactaatctctaagctgcnngggtctttttgtgtgaatatttaatggtgctccatgactgttgagtt

SEQ ID NO: 3831 - DNA, 25 bp, Artificial sequence
  Affy probe set ID: 235371_at
gaggctgagcatgaaggtgtgtctg

SEQ ID NO: 3832 - DNA, 25 bp, Artificial sequence
  Affy probe set ID: 235371_at
tggaaaccgaggcgtctaccatgac

SEQ ID NO: 3833 - DNA, 25 bp, Artificial sequence
  Affy probe set ID: 235371_at
gagcactctatgaagcaatacggga

SEQ ID NO: 3834 - DNA, 25 bp, Artificial sequence
  Affy probe set ID: 235371_at
ggattttccctttcaagacaatctc

SEQ ID NO: 3835 - DNA, 25 bp, Artificial sequence
  Affy probe set ID: 235371_at
gacaatctctttcaatccatgtatt

SEQ ID NO: 3836 - DNA, 25 bp, Artificial sequence
  Affy probe set ID: 235371_at
gtattacccccttcagctgaagttt

SEQ ID NO: 3837 - DNA, 25 bp, Artificial sequence
  Affy probe set ID: 235371_at
acactttatgtggacgaatcccgca

SEQ ID NO: 3838 - DNA, 25 bp, Artificial sequence
  Affy probe set ID: 235371_at
gaatcccgcaagtttttctgaagca

SEQ ID NO: 3839 - DNA, 25 bp, Artificial sequence
  Affy probe set ID: 235371_at
aaacacgtcatcatccatgttggcc

SEQ ID NO: 3840 - DNA, 25 bp, Artificial sequence
  Affy probe set ID: 235371_at
ggccccaaccagatgcactgaatat

SEQ ID NO: 3841 - DNA, 25 bp, Artificial sequence
  Affy probe set ID: 235371_at
aatggtgctccatgactgttgagtt

SEQ ID NO: 3842 - DNA, 496 bp, Artificial sequence
  Target_Sequence, Fragment of GenBank Accession No. NM_018153
gatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctat

SEQ ID NO: 3843 - DNA, 25 bp, Artificial sequence
  Affy probe set ID: 224694_at
gatatctggccatgggtaacctcat

SEQ ID NO: 3844 - DNA, 25 bp, Artificial sequence
  Affy probe set ID: 224694_at
tgggtaacctcattgtaactatcat

SEQ ID NO: 3845 - DNA, 25 bp, Artificial sequence
  Affy probe set ID: 224694_at
gatgatcttgaagtgtcacatacac

SEQ ID NO: 3846 - DNA, 25 bp, Artificial sequence
  Affy probe set ID: 224694_at
cagcccaatgtcaacccagttaaaa

SEQ ID NO: 3847 - DNA, 25 bp, Artificial sequence
  Affy probe set ID: 224694_at
aagtctgttaatgcacatcctgtgg

SEQ ID NO: 3848 - DNA, 25 bp, Artificial sequence
  Affy probe set ID: 224694_at
gagtgttctaaccaattgccttttc

SEQ ID NO: 3849 - DNA, 25 bp, Artificial sequence
  Affy probe set ID: 224694_at
ttgccttttcttgttatctgagctc

SEQ ID NO: 3850 - DNA, 25 bp, Artificial sequence
  Affy probe set ID: 224694_at
agctctcctatattatcatactcag

SEQ ID NO: 3851 - DNA, 25 bp, Artificial sequence
  Affy probe set ID: 224694_at
cacttaacattaaactcttctaact

SEQ ID NO: 3852 - DNA, 25 bp, Artificial sequence
  Affy probe set ID: 224694_at
atggatcttcaatgcctctgagtca

SEQ ID NO: 3853 - DNA, 25 bp, Artificial sequence
  Affy probe set ID: 224694_at
atcagttatcactataccatgctat

SEQ ID NO: 3854 - DNA, 516 bp, Artificial sequence
  Target_Sequence, Fragment of GenBank Accession No. NM_001733
  misc_feature (219)..(219): n is a, c, g, or t
ccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagnctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcga

SEQ ID NO: 3855 - DNA, 25 bp, Artificial sequence
  Affy probe set ID: 212067_s_at
ccacccggactaccgtcaggatgag

SEQ ID NO: 3856 - DNA, 25 bp, Artificial sequence
  Affy probe set ID: 212067_s_at
attttgagggggacatcgccctgct

SEQ ID NO: 3857 - DNA, 25 bp, Artificial sequence
  Affy probe set ID: 212067_s_at
tccctgacaacgataccttctacga

SEQ ID NO: 3858 - DNA, 25 bp, Artificial sequence
  Affy probe set ID: 212067_s_at
ccttctacgacctgggcttgatggg

SEQ ID NO: 3859 - DNA, 25 bp, Artificial sequence
  Affy probe set ID: 212067_s_at
tcagtggcttcggggtcatggagga

SEQ ID NO: 3860 - DNA, 25 bp, Artificial sequence
  Affy probe set ID: 212067_s_at
cacaggcctgtgagaactggctccg

SEQ ID NO: 3861 - DNA, 25 bp, Artificial sequence
  Affy probe set ID: 212067_s_at
acccatctctaaagcaggacgcctg

SEQ ID NO: 3862 - DNA, 25 bp, Artificial sequence
  Affy probe set ID: 212067_s_at
ggacccgaacactgatcgctgggtg

SEQ ID NO: 3863 - DNA, 25 bp, Artificial sequence
  Affy probe set ID: 212067_s_at
gtgcagcaggggctatggcttctac

SEQ ID NO: 3864 - DNA, 25 bp, Artificial sequence
  Affy probe set ID: 212067_s_at
ggcttctacaccaaagtgctcaact

SEQ ID NO: 3865 - DNA, 25 bp, Artificial sequence
  Affy probe set ID: 212067_s_at
tgagcccagaattcactaggttcga

SEQ ID NO: 3866 - DNA, 428 bp, Artificial sequence
  Target_Sequence, Fragment of GenBank Accession No. NM_001797
gaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacatataaatatcagtattctgacatgtaagaaaatgttacggcatcacacttatatttta

SEQ ID NO: 3867 - DNA, 25 bp, Artificial sequence
  Affy probe set ID: 207173_x_at
gaacatccaagtctttcttcttttt

SEQ ID NO: 3868 - DNA, 25 bp, Artificial sequence
  Affy probe set ID: 207173_x_at
agttctgagctgtaatttcgcctta

SEQ ID NO: 3869 - DNA, 25 bp, Artificial sequence
  Affy probe set ID: 207173_x_at
tttcgccttaaactctggacactct

SEQ ID NO: 3870 - DNA, 25 bp, Artificial sequence
  Affy probe set ID: 207173_x_at
ttcagccagcttaaacccatacaat

SEQ ID NO: 3871 - DNA, 25 bp, Artificial sequence
  Affy probe set ID: 207173_x_at
tgtacaattatgtctcttgagcatc

SEQ ID NO: 3872 - DNA, 25 bp, Artificial sequence
  Affy probe set ID: 207173_x_at
gagcatcaatcttgttactgctgat

SEQ ID NO: 3873 - DNA, 25 bp, Artificial sequence
  Affy probe set ID: 207173_x_at
ttgcttctactttcatcttaaacta

SEQ ID NO: 3874 - DNA, 25 bp, Artificial sequence
  Affy probe set ID: 207173_x_at
gtgccagatataactgtcttgtttc

SEQ ID NO: 3875 - DNA, 25 bp, Artificial sequence
  Affy probe set ID: 207173_x_at
gtttcagtgagagacgccctatttc

SEQ ID NO: 3876 - DNA, 25 bp, Artificial sequence
  Affy probe set ID: 207173_x_at
acgccctatttctatgtcattttta

SEQ ID NO: 3877 - DNA, 25 bp, Artificial sequence
  Affy probe set ID: 207173_x_at
gttacggcatcacacttatatttta

SEQ ID NO: 3878 - DNA, 533 bp, Artificial sequence
  Target_Sequence, Fragment of GenBank Accession No. NM_016938
atgagtgtgagtctggtgcgcaccagtgctccgaggcccaaacctgtgtcaacttccatgggggctaccgctgcgtggacaccaaccgctgcgtggagccctacatccaggtctctgagaaccgctgtctctgcccggcctccaaccctctatgtcgagagcagccttcatccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattaggcaaatcaacaacgtcagcgccatgctggtcctcgcccggccggtgacgggcccccgggagtacgtgctggacctggagatggtcaccatgaattccctcatgagctaccgggccagctctgtactgaggctcaccgtctttgtaggggcctacaccttctgaggagcaggagggagccaccctccctgcagctaccctagctgaggagcctgttgt

SEQ ID NO: 3879 - DNA, 25 bp, Artificial sequence
  Affy probe set ID: 209356_x_at
atgagtgtgagtctggtgcgcacca

SEQ ID NO: 3880 - DNA, 25 bp, Artificial sequence
  Affy probe set ID: 209356_x_at
ctgtgtcaacttccatgggggctac

SEQ ID NO: 3881 - DNA, 25 bp, Artificial sequence
  Affy probe set ID: 209356_x_at
atccaggtctctgagaaccgctgtc

SEQ ID NO: 3882 - DNA, 25 bp, Artificial sequence
  Affy probe set ID: 209356_x_at
cctacaatgcctttcagatccgtgc

SEQ ID NO: 3883 - DNA, 25 bp, Artificial sequence
  Affy probe set ID: 209356_x_at
agatccgtgctggaaactcgcaggg

SEQ ID NO: 3884 - DNA, 25 bp, Artificial sequence
  Affy probe set ID: 209356_x_at
gcaaatcaacaacgtcagcgccatg

SEQ ID NO: 3885 - DNA, 25 bp, Artificial sequence
  Affy probe set ID: 209356_x_at
ggagtacgtgctggacctggagatg

SEQ ID NO: 3886 - DNA, 25 bp, Artificial sequence
  Affy probe set ID: 209356_x_at
tgaattccctcatgagctaccgggc

SEQ ID NO: 3887 - DNA, 25 bp, Artificial sequence
  Affy probe set ID: 209356_x_at
aggctcaccgtctttgtaggggcct

SEQ ID NO: 3888 - DNA, 25 bp, Artificial sequence
  Affy probe set ID: 209356_x_at
ggcctacaccttctgaggagcagga

SEQ ID NO: 3889 - DNA, 25 bp, Artificial sequence
  Affy probe set ID: 209356_x_at
ctaccctagctgaggagcctgttgt

SEQ ID NO: 3890 - DNA, 464 bp, Artificial sequence
  Target_Sequence, Fragment of GenBank Accession No. NM_014601
  misc_feature (76)..(76): n is a, c, g, or t
  misc_feature (87)..(101): n is a, c, g, or t
  misc_feature (259)..(318): n is a, c, g, or t
cccttggagatatttccgtcctccacccacgtgtctgtggctggaactgcccagcctgctcctggccccctggaancctccccacannnnnnnnnnnnnnnttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccnnnnnnnnnnnnnnnnnnnnnnnnnnnnnnnnnnnnnnnnnnnnnnnnnnnnnnnnnnnncaggggaccccatggaaaagatggggaagagcaaaatacatggagacgacgcaccctccaggatgctcgctgggattcccacgcccaccactgtcccccaccccatggctgggaggggcctctgaacggaacagtgtccccacaga

SEQ ID NO: 3891 - DNA, 25 bp, Artificial sequence
  Affy probe set ID: 45297_at
cccttggagatatttccgtcctcca

SEQ ID NO: 3892 - DNA, 25 bp, Artificial sequence
  Affy probe set ID: 45297_at
tgtggctggaactgcccagcctgct

SEQ ID NO: 3893 - DNA, 25 bp, Artificial sequence
  Affy probe set ID: 45297_at
accaccattccatatttaagtggag

SEQ ID NO: 3894 - DNA, 25 bp, Artificial sequence
  Affy probe set ID: 45297_at
ttccatatttaagtggagcccctac

SEQ ID NO: 3895 - DNA, 25 bp, Artificial sequence
  Affy probe set ID: 45297_at
atatttaagtggagcccctacgtag

SEQ ID NO: 3896 - DNA, 25 bp, Artificial sequence
  Affy probe set ID: 45297_at
tattttagtctccttttcagggatg

SEQ ID NO: 3897 - DNA, 25 bp, Artificial sequence
  Affy probe set ID: 45297_at
tttagtctccttttcagggatgtcg

SEQ ID NO: 3898 - DNA, 25 bp, Artificial sequence
  Affy probe set ID: 45297_at
tagtctccttttcagggatgtcgtg

SEQ ID NO: 3899 - DNA, 25 bp, Artificial sequence
  Affy probe set ID: 45297_at
agtctccttttcagggatgtcgtgg

SEQ ID NO: 3900 - DNA, 25 bp, Artificial sequence
  Affy probe set ID: 45297_at
agggggttcttggtgctacagccct

SEQ ID NO: 3901 - DNA, 25 bp, Artificial sequence
  Affy probe set ID: 45297_at
gggttcttggtgctacagccctctc

SEQ ID NO: 3902 - DNA, 25 bp, Artificial sequence
  Affy probe set ID: 45297_at
accctccaggatgctcgctgggatt

SEQ ID NO: 3903 - DNA, 25 bp, Artificial sequence
  Affy probe set ID: 45297_at
ccctccaggatgctcgctgggattc

SEQ ID NO: 3904 - DNA, 25 bp, Artificial sequence
  Affy probe set ID: 45297_at
caggatgctcgctgggattcccacg

SEQ ID NO: 3905 - DNA, 25 bp, Artificial sequence
  Affy probe set ID: 45297_at
aggggcctctgaacggaacagtgtc

SEQ ID NO: 3906 - DNA, 25 bp, Artificial sequence
  Affy probe set ID: 45297_at
ctgaacggaacagtgtccccacaga

SEQ ID NO: 3907 - DNA, 388 bp, Artificial sequence
  Target_Sequence, Fragment of GenBank Accession No. NM_017789
  misc_feature (26)..(26): n is a, c, g, or t
  misc_feature (36)..(36): n is a, c, g, or t
  misc_feature (53)..(53): n is a, c, g, or t
  misc_feature (215)..(215): n is a, c, g, or t
  misc_feature (254)..(275): n is a, c, g, or t
  misc_feature (298)..(298): n is a, c, g, or t
gggtcgtatcactttgtctctcctancccccactgnccccgagtgtcgggcancgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggncctcccacttggccccggggttcagtggtattttatacnnnnnnnnnnnnnnnnnnnnnntgggaaaggctgtgtgagggganagaagggagagggtgggcctgctgtggacaatggcatactctcttccagccctaggaggagggctcctaacagtgtaacttattgtgtcc

SEQ ID NO: 3908 - DNA, 25 bp, Artificial sequence
  Affy probe set ID: 46665_at
gggtcgtatcactttgtctctccta

SEQ ID NO: 3909 - DNA, 25 bp, Artificial sequence
  Affy probe set ID: 46665_at
ggacagggtgctgtgccccttcaga

SEQ ID NO: 3910 - DNA, 25 bp, Artificial sequence
  Affy probe set ID: 46665_at
gtgggcctagtcctgctcctagggc

SEQ ID NO: 3911 - DNA, 25 bp, Artificial sequence
  Affy probe set ID: 46665_at
tgctcctagggctgtgaatgttttc

SEQ ID NO: 3912 - DNA, 25 bp, Artificial sequence
  Affy probe set ID: 46665_at
ctcctagggctgtgaatgttttcag

SEQ ID NO: 3913 - DNA, 25 bp, Artificial sequence
  Affy probe set ID: 46665_at
tcctagggctgtgaatgttttcagg

SEQ ID NO: 3914 - DNA, 25 bp, Artificial sequence
  Affy probe set ID: 46665_at
tgggcctgctgtggacaatggcata

SEQ ID NO: 3915 - DNA, 25 bp, Artificial sequence
  Affy probe set ID: 46665_at
ggcctgctgtggacaatggcatact

SEQ ID NO: 3916 - DNA, 25 bp, Artificial sequence
  Affy probe set ID: 46665_at
cctgctgtggacaatggcatactct

SEQ ID NO: 3917 - DNA, 25 bp, Artificial sequence
  Affy probe set ID: 46665_at
ggacaatggcatactctcttccagc

SEQ ID NO: 3918 - DNA, 25 bp, Artificial sequence
  Affy probe set ID: 46665_at
gacaatggcatactctcttccagcc

SEQ ID NO: 3919 - DNA, 25 bp, Artificial sequence
  Affy probe set ID: 46665_at
aggagggctcctaacagtgtaactt

SEQ ID NO: 3920 - DNA, 25 bp, Artificial sequence
  Affy probe set ID: 46665_at
ggagggctcctaacagtgtaactta

SEQ ID NO: 3921 - DNA, 25 bp, Artificial sequence
  Affy probe set ID: 46665_at
agggctcctaacagtgtaacttatt

SEQ ID NO: 3922 - DNA, 25 bp, Artificial sequence
  Affy probe set ID: 46665_at
ctcctaacagtgtaacttattgtgt

SEQ ID NO: 3923 - DNA, 25 bp, Artificial sequence
  Affy probe set ID: 46665_at
cctaacagtgtaacttattgtgtcc

SEQ ID NO: 3924 - DNA, 307 bp, Artificial sequence
  Target_Sequence, Fragment of GenBank Accession No. NM_000484
gaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttca

SEQ ID NO: 3925 - DNA, 25 bp, Artificial sequence
  Affy probe set ID: 200602_at
gaattctccaaaacaattttctgca

SEQ ID NO: 3926 - DNA, 25 bp, Artificial sequence
  Affy probe set ID: 200602_at
aattttctgcaggatgattgtacag

SEQ ID NO: 3927 - DNA, 25 bp, Artificial sequence
  Affy probe set ID: 200602_at
gattgtacagaatcattgcttatga

SEQ ID NO: 3928 - DNA, 25 bp, Artificial sequence
  Affy probe set ID: 200602_at
tgcttatgacatgatcgctttctac

SEQ ID NO: 3929 - DNA, 25 bp, Artificial sequence
  Affy probe set ID: 200602_at
catgatcgctttctacactgtatta

SEQ ID NO: 3930 - DNA, 25 bp, Artificial sequence
  Affy probe set ID: 200602_at
gatcgctttctacactgtattacat

SEQ ID NO: 3931 - DNA, 25 bp, Artificial sequence
  Affy probe set ID: 200602_at
acttttctttgaaggatgactacag

SEQ ID NO: 3932 - DNA, 25 bp, Artificial sequence
  Affy probe set ID: 200602_at
caattttctttaaccagtctgaagt

SEQ ID NO: 3933 - DNA, 25 bp, Artificial sequence
  Affy probe set ID: 200602_at
taaccagtctgaagtttcatttatg

SEQ ID NO: 3934 - DNA, 25 bp, Artificial sequence
  Affy probe set ID: 200602_at
ctggacaaacccttcttttaagatg

SEQ ID NO: 3935 - DNA, 25 bp, Artificial sequence
  Affy probe set ID: 200602_at
acccttcttttaagatgtgtcttca

SEQ ID NO: 3936 - DNA, 511 bp, Artificial sequence
  Target_Sequence, Fragment of GenBank Accession No. NM_004684
aacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttac

SEQ ID NO: 3937 - DNA, 25 bp, Artificial sequence
  Affy probe set ID: 200795_at
aacactgcataacccgtttctttga

SEQ ID NO: 3938 - DNA, 25 bp, Artificial sequence
  Affy probe set ID: 200795_at
tgaggagtgtgaccccaacaaggat

SEQ ID NO: 3939 - DNA, 25 bp, Artificial sequence
  Affy probe set ID: 200795_at
aggataagcacatcaccctgaagga

SEQ ID NO: 3940 - DNA, 25 bp, Artificial sequence
  Affy probe set ID: 200795_at
agtggggccactgctttggaattaa

SEQ ID NO: 3941 - DNA, 25 bp, Artificial sequence
  Affy probe set ID: 200795_at
aaagaactcaactttccagcatcct

SEQ ID NO: 3942 - DNA, 25 bp, Artificial sequence
  Affy probe set ID: 200795_at
ctcctctgttctaaccacttcagaa

SEQ ID NO: 3943 - DNA, 25 bp, Artificial sequence
  Affy probe set ID: 200795_at
atatgcagctgtgatacttgtagat

SEQ ID NO: 3944 - DNA, 25 bp, Artificial sequence
  Affy probe set ID: 200795_at
gcttgacaacaacctatgcaccagg

SEQ ID NO: 3945 - DNA, 25 bp, Artificial sequence
  Affy probe set ID: 200795_at
gtaatttcactctctgcattgactt

SEQ ID NO: 3946 - DNA, 25 bp, Artificial sequence
  Affy probe set ID: 200795_at
gttcataatatcatgtgcacttcaa

SEQ ID NO: 3947 - DNA, 25 bp, Artificial sequence
  Affy probe set ID: 200795_at
ggaatgctactcttttgtggtttac

SEQ ID NO: 3948 - DNA, 241 bp, Artificial sequence
  Target_Sequence, Fragment of GenBank Accession No. NM_002291
aagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggag

SEQ ID NO: 3949 - DNA, 25 bp, Artificial sequence
  Affy probe set ID: 201505_at
aagagtcagctgatgccagaaggaa

SEQ ID NO: 3950 - DNA, 25 bp, Artificial sequence
  Affy probe set ID: 201505_at
gatgccagaaggaaagccgaaatgc

SEQ ID NO: 3951 - DNA, 25 bp, Artificial sequence
  Affy probe set ID: 201505_at
gaagcaaaaactcttttagctcaag

SEQ ID NO: 3952 - DNA, 25 bp, Artificial sequence
  Affy probe set ID: 201505_at
aactcttttagctcaagcaaatagc

SEQ ID NO: 3953 - DNA, 25 bp, Artificial sequence
  Affy probe set ID: 201505_at
gcaaatagcaagctgcaactgctca

SEQ ID NO: 3954 - DNA, 25 bp, Artificial sequence
  Affy probe set ID: 201505_at
gctgcaactgctcaaagatttagaa

SEQ ID NO: 3955 - DNA, 25 bp, Artificial sequence
  Affy probe set ID: 201505_at
aaagctcaagaattagcaagactgg

SEQ ID NO: 3956 - DNA, 25 bp, Artificial sequence
  Affy probe set ID: 201505_at
actggaaggagaagtccgttcactc

SEQ ID NO: 3957 - DNA, 25 bp, Artificial sequence
  Affy probe set ID: 201505_at
gaagtccgttcactcctaaaggata

SEQ ID NO: 3958 - DNA, 25 bp, Artificial sequence
  Affy probe set ID: 201505_at
agttgctgtgtatagcacatgcttg

SEQ ID NO: 3959 - DNA, 25 bp, Artificial sequence
  Affy probe set ID: 201505_at
atagcacatgcttgtaacagaggag

SEQ ID NO: 3960 - DNA, 515 bp, Artificial sequence
  Target_Sequence, Fragment of GenBank Accession No. NM_000210
gtagtgccactgttgttttggggggggctttttttctttttccggaaaatccttaaaccttaagatactaaggacgttgttttggttgtacttggaattcttagtcacaaaatatattttgtttacaaaaatttctgtaaaacaggttataacagtgtttaaagtctcagtttcttgcttggggaacttgtgtccctaatgtgttagattgctagattgctaaggagctgatacttgacagttttttagacctgtgttactaaaaaaaagatgaatgtcggaaaagggtgttgggagggtggtcaacaaagaaacaaagatgttatggtgtttagacttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcatt

SEQ ID NO: 3961 - DNA, 25 bp, Artificial sequence
  Affy probe set ID: 201656_at
gtagtgccactgttgttttgggggg

SEQ ID NO: 3962 - DNA, 25 bp, Artificial sequence
  Affy probe set ID: 201656_at
gatactaaggacgttgttttggttg

SEQ ID NO: 3963 - DNA, 25 bp, Artificial sequence
  Affy probe set ID: 201656_at
ggttgtacttggaattcttagtcac

SEQ ID NO: 3964 - DNA, 25 bp, Artificial sequence
  Affy probe set ID: 201656_at
taacagtgtttaaagtctcagtttc

SEQ ID NO: 3965 - DNA, 25 bp, Artificial sequence
  Affy probe set ID: 201656_at
ggaacttgtgtccctaatgtgttag

SEQ ID NO: 3966 - DNA, 25 bp, Artificial sequence
  Affy probe set ID: 201656_at
aaggagctgatacttgacagttttt

SEQ ID NO: 3967 - DNA, 25 bp, Artificial sequence
  Affy probe set ID: 201656_at
gacagttttttagacctgtgttact

SEQ ID NO: 3968 - DNA, 25 bp, Artificial sequence
  Affy probe set ID: 201656_at
tatggtgtttagacttatggttgtt

SEQ ID NO: 3969 - DNA, 25 bp, Artificial sequence
  Affy probe set ID: 201656_at
gtcatctcaagtcaagtcactggtc

SEQ ID NO: 3970 - DNA, 25 bp, Artificial sequence
  Affy probe set ID: 201656_at
gtcactggtctgtttgcatttgata

SEQ ID NO: 3971 - DNA, 25 bp, Artificial sequence
  Affy probe set ID: 201656_at
gttcattgtttcgtaacacagcatt

SEQ ID NO: 3972 - DNA, 566 bp, Artificial sequence
  Target_Sequence, Fragment of GenBank Accession No. NM_000552
gatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgctgc

SEQ ID NO: 3973 - DNA, 25 bp, Artificial sequence
  Affy probe set ID: 202112_at
gatactcacttctgcaaggtcaatg

SEQ ID NO: 3974 - DNA, 25 bp, Artificial sequence
  Affy probe set ID: 202112_at
tgcccaccctttgatgaacacaagt

SEQ ID NO: 3975 - DNA, 25 bp, Artificial sequence
  Affy probe set ID: 202112_at
gaggagcctgagtgcaacgacatca

SEQ ID NO: 3976 - DNA, 25 bp, Artificial sequence
  Affy probe set ID: 202112_at
tgccaggctgcagtatgtcaaggtg

SEQ ID NO: 3977 - DNA, 25 bp, Artificial sequence
  Affy probe set ID: 202112_at
gatatccactactgccagggcaaat

SEQ ID NO: 3978 - DNA, 25 bp, Artificial sequence
  Affy probe set ID: 202112_at
aatgtgccagcaaagccatgtactc

SEQ ID NO: 3979 - DNA, 25 bp, Artificial sequence
  Affy probe set ID: 202112_at
tgtgcaggaccagtgctcctgctgc

SEQ ID NO: 3980 - DNA, 25 bp, Artificial sequence
  Affy probe set ID: 202112_at
tgcaccaatggctctgttgtgtacc

SEQ ID NO: 3981 - DNA, 25 bp, Artificial sequence
  Affy probe set ID: 202112_at
gccatggagtgcaaatgctccccca

SEQ ID NO: 3982 - DNA, 25 bp, Artificial sequence
  Affy probe set ID: 202112_at
tgctcccccaggaagtgcagcaagt

SEQ ID NO: 3983 - DNA, 25 bp, Artificial sequence
  Affy probe set ID: 202112_at
aaaggctgagctcttatcttgctgc

SEQ ID NO: 3984 - DNA, 550 bp, Artificial sequence
  Target_Sequence, Fragment of GenBank Accession No. NM_001233
  misc_feature (384)..(384): n is a, c, g, or t
atgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacngtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcat

SEQ ID NO: 3985 - DNA, 25 bp, Artificial sequence
  Affy probe set ID: 203323_at
atgaagctcatatccttttgaaggt

SEQ ID NO: 3986 - DNA, 25 bp, Artificial sequence
  Affy probe set ID: 203323_at
gagacatttcaaaactgccctaggc

SEQ ID NO: 3987 - DNA, 25 bp, Artificial sequence
  Affy probe set ID: 203323_at
cctaggccattgcagcatccttaga

SEQ ID NO: 3988 - DNA, 25 bp, Artificial sequence
  Affy probe set ID: 203323_at
gatgggacgcataatcattacctta

SEQ ID NO: 3989 - DNA, 25 bp, Artificial sequence
  Affy probe set ID: 203323_at
attaccttaaagcatcaccactcat

SEQ ID NO: 3990 - DNA, 25 bp, Artificial sequence
  Affy probe set ID: 203323_at
aagcatcaccactcattttgaccat

SEQ ID NO: 3991 - DNA, 25 bp, Artificial sequence
  Affy probe set ID: 203323_at
aaggtcaatcagcctcatgacttta

SEQ ID NO: 3992 - DNA, 25 bp, Artificial sequence
  Affy probe set ID: 203323_at
gctatcctttcaaacagctattggc

SEQ ID NO: 3993 - DNA, 25 bp, Artificial sequence
  Affy probe set ID: 203323_at
aagtaacatgacttccttatttctg

SEQ ID NO: 3994 - DNA, 25 bp, Artificial sequence
  Affy probe set ID: 203323_at
aaatccaggctttatgtacaaacat

SEQ ID NO: 3995 - DNA, 25 bp, Artificial sequence
  Affy probe set ID: 203323_at
gatgagcagacttctcggaattcat

SEQ ID NO: 3996 - DNA, 465 bp, Artificial sequence
  Target_Sequence, Fragment of GenBank Accession No. NM_006404
ttcctgtgcacaggtggacggcgatgttaattactctccagccccgtcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatgcgccatcctccaaagacagacagaatcacctgaggcgttcaaaagatataaccaaataaacaagtcatccacaatcaaaatacaacattcaatacttccaggtgtgtcagacttgggatgggacgctgatataa

SEQ ID NO: 3997 - DNA, 25 bp, Artificial sequence
  Affy probe set ID: 203650_at
ttcctgtgcacaggtggacggcgat

SEQ ID NO: 3998 - DNA, 25 bp, Artificial sequence
  Affy probe set ID: 203650_at
gacggcgatgttaattactctccag

SEQ ID NO: 3999 - DNA, 25 bp, Artificial sequence
  Affy probe set ID: 203650_at
ggggctggattgatggaggctggca

SEQ ID NO: 4000 - DNA, 25 bp, Artificial sequence
  Affy probe set ID: 203650_at
gaaagtttcagctcactgtgaagcc

SEQ ID NO: 4001 - DNA, 25 bp, Artificial sequence
  Affy probe set ID: 203650_at
cccacatctgcccactgaagatttg

SEQ ID NO: 4002 - DNA, 25 bp, Artificial sequence
  Affy probe set ID: 203650_at
gaacctaagaacgtgtatgctttgc

SEQ ID NO: 4003 - DNA, 25 bp, Artificial sequence
  Affy probe set ID: 203650_at
gtatgctttgctgaattagtctgat

SEQ ID NO: 4004 - DNA, 25 bp, Artificial sequence
  Affy probe set ID: 203650_at
agtgaatgtttatctatctttgtgg

SEQ ID NO: 4005 - DNA, 25 bp, Artificial sequence
  Affy probe set ID: 203650_at
aatacaacattcaatacttccaggt

SEQ ID NO: 4006 - DNA, 25 bp, Artificial sequence
  Affy probe set ID: 203650_at
tacttccaggtgtgtcagacttggg

SEQ ID NO: 4007 - DNA, 25 bp, Artificial sequence
  Affy probe set ID: 203650_at
gacttgggatgggacgctgatataa

SEQ ID NO: 4008 - DNA, 388 bp, Artificial sequence
  Target_Sequence, Fragment of GenBank Accession No. NM_000609
  misc_feature (291)..(291): n is a, c, g, or t
ctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgnaacctcgctggactctcagtctctgagcagtgaatgattcagtgttaaatgtgatgaatactgtattttgtattgtttcaattgcatctcccagata

SEQ ID NO: 4009 - DNA, 25 bp, Artificial sequence
  Affy probe set ID: 203666_at
ctcccccaaccttagatgttctaag

SEQ ID NO: 4010 - DNA, 25 bp, Artificial sequence
  Affy probe set ID: 203666_at
attggatctcattggacccttccat

SEQ ID NO: 4011 - DNA, 25 bp, Artificial sequence
  Affy probe set ID: 203666_at
cttccatggtgtgatcgtctgactg

SEQ ID NO: 4012 - DNA, 25 bp, Artificial sequence
  Affy probe set ID: 203666_at
gactggtgttatcaccgtgggctcc

SEQ ID NO: 4013 - DNA, 25 bp, Artificial sequence
  Affy probe set ID: 203666_at
ctgactgggagttgatcgcctttcc

SEQ ID NO: 4014 - DNA, 25 bp, Artificial sequence
  Affy probe set ID: 203666_at
gagtgctctgatccctctacagagc

SEQ ID NO: 4015 - DNA, 25 bp, Artificial sequence
  Affy probe set ID: 203666_at
cctgactcattctgaaggagcccca

SEQ ID NO: 4016 - DNA, 25 bp, Artificial sequence
  Affy probe set ID: 203666_at
gaaggagccccattcctgggaaata

SEQ ID NO: 4017 - DNA, 25 bp, Artificial sequence
  Affy probe set ID: 203666_at
aaatcccctaagcagaccactgata

SEQ ID NO: 4018 - DNA, 25 bp, Artificial sequence
  Affy probe set ID: 203666_at
tggactctcagtctctgagcagtga

SEQ ID NO: 4019 - DNA, 25 bp, Artificial sequence
  Affy probe set ID: 203666_at
ttgtttcaattgcatctcccagata

SEQ ID NO: 4020 - DNA, 557 bp, Artificial sequence
  Target_Sequence, Fragment of GenBank Accession No. NM_002253
gtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaat

SEQ ID NO: 4021 - DNA, 25 bp, Artificial sequence
  Affy probe set ID: 203934_at
gtttcttctggaatgaataccctca

SEQ ID NO: 4022 - DNA, 25 bp, Artificial sequence
  Affy probe set ID: 203934_at
taccctcatatctgtcctgatgtga

SEQ ID NO: 4023 - DNA, 25 bp, Artificial sequence
  Affy probe set ID: 203934_at
atgtctgagactgaatgcgggaggt

SEQ ID NO: 4024 - DNA, 25 bp, Artificial sequence
  Affy probe set ID: 203934_at
gcgggaggttcaatgtgaagctgtg

SEQ ID NO: 4025 - DNA, 25 bp, Artificial sequence
  Affy probe set ID: 203934_at
gaagctgtgtgtggtgtcaaagttt

SEQ ID NO: 4026 - DNA, 25 bp, Artificial sequence
  Affy probe set ID: 203934_at
ccccgcaacccatcagtattttagt

SEQ ID NO: 4027 - DNA, 25 bp, Artificial sequence
  Affy probe set ID: 203934_at
acctgattgggtttgttcactctct

SEQ ID NO: 4028 - DNA, 25 bp, Artificial sequence
  Affy probe set ID: 203934_at
ttcactctctgaatgattattagcc

SEQ ID NO: 4029 - DNA, 25 bp, Artificial sequence
  Affy probe set ID: 203934_at
atttctactgatttttgcccttgtt

SEQ ID NO: 4030 - DNA, 25 bp, Artificial sequence
  Affy probe set ID: 203934_at
gaactttgtactattcacattttgt

SEQ ID NO: 4031 - DNA, 25 bp, Artificial sequence
  Affy probe set ID: 203934_at
caaaggtcataatgctttcagcaat

SEQ ID NO: 4032 - DNA, 501 bp, Artificial sequence
  Target_Sequence, Fragment of GenBank Accession No. NM_001442
gtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccctgatttagcaagca

SEQ ID NO: 4033 - DNA, 25 bp, Artificial sequence
  Affy probe set ID: 203980_at
gtgtgatgcttttgtaggtacctgg

SEQ ID NO: 4034 - DNA, 25 bp, Artificial sequence
  Affy probe set ID: 203980_at
taggagtgggctttgccaccaggaa

SEQ ID NO: 4035 - DNA, 25 bp, Artificial sequence
  Affy probe set ID: 203980_at
gaaagtggctggcatggccaaacct

SEQ ID NO: 4036 - DNA, 25 bp, Artificial sequence
  Affy probe set ID: 203980_at
ggccaaacctaacatgatcatcagt

SEQ ID NO: 4037 - DNA, 25 bp, Artificial sequence
  Affy probe set ID: 203980_at
ctgagatttccttcatactgggcca

SEQ ID NO: 4038 - DNA, 25 bp, Artificial sequence
  Affy probe set ID: 203980_at
ggggtgtcctggtacatgtgcagaa

SEQ ID NO: 4039 - DNA, 25 bp, Artificial sequence
  Affy probe set ID: 203980_at
aactggtggtggaatgcgtcatgaa

SEQ ID NO: 4040 - DNA, 25 bp, Artificial sequence
  Affy probe set ID: 203980_at
aaaggcgtcacttccacgagagttt

SEQ ID NO: 4041 - DNA, 25 bp, Artificial sequence
  Affy probe set ID: 203980_at
gacgttgacctggactgaagttcgc

SEQ ID NO: 4042 - DNA, 25 bp, Artificial sequence
  Affy probe set ID: 203980_at
gttcgcattgaactctacaacattc

SEQ ID NO: 4043 - DNA, 25 bp, Artificial sequence
  Affy probe set ID: 203980_at
gttgttttccctgatttagcaagca

SEQ ID NO: 4044 - DNA, 455 bp, Artificial sequence
  Target_Sequence, Fragment of GenBank Accession No. NM_016315
tatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttacttctccagtgcgtttttatgaagatctggttgaaaattgtatttctatgtaaactcaacgatatgtttggttttcctgaa

SEQ ID NO: 4045 - DNA, 25 bp, Artificial sequence
  Affy probe set ID: 204237_at
tatgagccttcttgtttagtttctt

SEQ ID NO: 4046 - DNA, 25 bp, Artificial sequence
  Affy probe set ID: 204237_at
gtttcttttatctgctaagttgtac

SEQ ID NO: 4047 - DNA, 25 bp, Artificial sequence
  Affy probe set ID: 204237_at
taggtatatatttagtggccattta

SEQ ID NO: 4048 - DNA, 25 bp, Artificial sequence
  Affy probe set ID: 204237_at
ggagtactaagatggtatttgcaca

SEQ ID NO: 4049 - DNA, 25 bp, Artificial sequence
  Affy probe set ID: 204237_at
taagatatgttactttaccaatttt

SEQ ID NO: 4050 - DNA, 25 bp, Artificial sequence
  Affy probe set ID: 204237_at
atggtaatcaactctgctactggca

SEQ ID NO: 4051 - DNA, 25 bp, Artificial sequence
  Affy probe set ID: 204237_at
tcaactctgctactggcatgatgaa

SEQ ID NO: 4052 - DNA, 25 bp, Artificial sequence
  Affy probe set ID: 204237_at
tacttctccagtgcgtttttatgaa

SEQ ID NO: 4053 - DNA, 25 bp, Artificial sequence
  Affy probe set ID: 204237_at
gtgcgtttttatgaagatctggttg

SEQ ID NO: 4054 - DNA, 25 bp, Artificial sequence
  Affy probe set ID: 204237_at
atttctatgtaaactcaacgatatg

SEQ ID NO: 4055 - DNA, 25 bp, Artificial sequence
  Affy probe set ID: 204237_at
caacgatatgtttggttttcctgaa

SEQ ID NO: 4056 - DNA, 441 bp, Artificial sequence
  Target_Sequence, Fragment of GenBank Accession No. NM_006307
ggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaacctttctttactccatcatggctggttgatttgtagagaaattagaacccataaccatacacaggctatcaacatgttattcaatgtgacacctaactcttttc

SEQ ID NO: 4057 - DNA, 25 bp, Artificial sequence
  Affy probe set ID: 204955_at
ggacaaagagcgctatgtctccctg

SEQ ID NO: 4058 - DNA, 25 bp, Artificial sequence
  Affy probe set ID: 204955_at
gccctgttcaacctgattgacactt

SEQ ID NO: 4059 - DNA, 25 bp, Artificial sequence
  Affy probe set ID: 204955_at
gagatggtcctacaagccgaaatga

SEQ ID NO: 4060 - DNA, 25 bp, Artificial sequence
  Affy probe set ID: 204955_at
gagccagacctgtaacacctgacat

SEQ ID NO: 4061 - DNA, 25 bp, Artificial sequence
  Affy probe set ID: 204955_at
gtaacacctgacatgatggttcctc

SEQ ID NO: 4062 - DNA, 25 bp, Artificial sequence
  Affy probe set ID: 204955_at
gacatgcacacgggaaagccttaaa

SEQ ID NO: 4063 - DNA, 25 bp, Artificial sequence
  Affy probe set ID: 204955_at
tagcatgctgctttttgtacttgga

SEQ ID NO: 4064 - DNA, 25 bp, Artificial sequence
  Affy probe set ID: 204955_at
gaccatatttactctttctaacctt

SEQ ID NO: 4065 - DNA, 25 bp, Artificial sequence
  Affy probe set ID: 204955_at
cctttctttactccatcatggctgg

SEQ ID NO: 4066 - DNA, 25 bp, Artificial sequence
  Affy probe set ID: 204955_at
gaacccataaccatacacaggctat

SEQ ID NO: 4067 - DNA, 25 bp, Artificial sequence
  Affy probe set ID: 204955_at
ttcaatgtgacacctaactcttttc

SEQ ID NO: 4068 - DNA, 489 bp, Artificial sequence
  Target_Sequence, Fragment of GenBank Accession No. NM_000163
agtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgataatgtgcttctg

SEQ ID NO: 4069 - DNA, 25 bp, Artificial sequence
  Affy probe set ID: 205498_at
agtatttcccatttatcgcagacct

SEQ ID NO: 4070 - DNA, 25 bp, Artificial sequence
  Affy probe set ID: 205498_at
taaattctctctcttgcaggaagga

SEQ ID NO: 4071 - DNA, 25 bp, Artificial sequence
  Affy probe set ID: 205498_at
tgatagattttctgctactttgctg

SEQ ID NO: 4072 - DNA, 25 bp, Artificial sequence
  Affy probe set ID: 205498_at
tactttgctgctatggttttctcca

SEQ ID NO: 4073 - DNA, 25 bp, Artificial sequence
  Affy probe set ID: 205498_at
cttactatttcacaacagcctgaca

SEQ ID NO: 4074 - DNA, 25 bp, Artificial sequence
  Affy probe set ID: 205498_at
agcctgacaacatttctatagccaa

SEQ ID NO: 4075 - DNA, 25 bp, Artificial sequence
  Affy probe set ID: 205498_at
gctaaatacctcaatcagtctcaga

SEQ ID NO: 4076 - DNA, 25 bp, Artificial sequence
  Affy probe set ID: 205498_at
ggccacataagccattattcactag

SEQ ID NO: 4077 - DNA, 25 bp, Artificial sequence
  Affy probe set ID: 205498_at
gtatgactagttgtgtctggcagtt

SEQ ID NO: 4078 - DNA, 25 bp, Artificial sequence
  Affy probe set ID: 205498_at
taactctctttatgtctgtggattt

SEQ ID NO: 4079 - DNA, 25 bp, Artificial sequence
  Affy probe set ID: 205498_at
ttggattcctgataatgtgcttctg

SEQ ID NO: 4080 - DNA, 444 bp, Artificial sequence
  Target_Sequence, Fragment of GenBank Accession No. NM_000950
gtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtt

SEQ ID NO: 4081 - DNA, 25 bp, Artificial sequence
  Target_Sequence, Fragment of GenBank Accession No. NM_000950
gtctttcttacctgattgatattac

SEQ ID NO: 4082 - DNA, 25 bp, Artificial sequence
  Affy probe set ID: 205618_at
gatattacattcacctttgattgtt

SEQ ID NO: 4083 - DNA, 25 bp, Artificial sequence
  Affy probe set ID: 205618_at
gaattgaatcaaccagtttgcattt

SEQ ID NO: 4084 - DNA, 25 bp, Artificial sequence
  Affy probe set ID: 205618_at
gtggtcttcctgtagaatggtttac

SEQ ID NO: 4085 - DNA, 25 bp, Artificial sequence
  Affy probe set ID: 205618_at
cagtagttgtgtctggaatcctaga

SEQ ID NO: 4086 - DNA, 25 bp, Artificial sequence
  Affy probe set ID: 205618_at
cctagaattggcactttctgcctcc

SEQ ID NO: 4087 - DNA, 25 bp, Artificial sequence
  Affy probe set ID: 205618_at
tgcctccttgctctaaatgtcacaa

SEQ ID NO: 4088 - DNA, 25 bp, Artificial sequence
  Affy probe set ID: 205618_at
cttcttttcctattgaccagtacag

SEQ ID NO: 4089 - DNA, 25 bp, Artificial sequence
  Affy probe set ID: 205618_at
aactgtggaggtagctttaacttgg

SEQ ID NO: 4090 - DNA, 25 bp, Artificial sequence
  Affy probe set ID: 205618_at
ggtagctttaacttggttctgtgta

SEQ ID NO: 4091 - DNA, 25 bp, Artificial sequence
  Affy probe set ID: 205618_at
atttctcattttaagatgcttggtt

SEQ ID NO: 4092 - DNA, 473 bp, Artificial sequence
  Target_Sequence, Fragment of GenBank Accession No. NM_002666
tccaggcctgtgtgctttgtagagccagctgcttgctcacagccacatttccatttgcatcattactgccttcacctgcatagtcactcttttgatgctggggaaccaaaatggtgatgatatatagactttatgtatagccacagttcatccccaaccctagtcttcgaaatgttaatatttgataaatctagaaaatgcattcatacaattacagaattcaaatattgcaaaaggatgtgtgtctttctccccgagctcccctgttccccttcattgaaaaccaccacggtgccatctcttgtgtatgcagggctatgcacctgcaggcacgtgtgtatgcactccccgcttgtgtttacacaagctgtggggtgttacgcatgcctgcttttttcacttaataatacagcttggagagatttttgtatcacattataaatcccactcgctctttttgatggccacataat

SEQ ID NO: 4093 - DNA, 25 bp, Artificial sequence
  Affy probe set ID: 205913_at
tccaggcctgtgtgctttgtagagc

SEQ ID NO: 4094 - DNA, 25 bp, Artificial sequence
  Affy probe set ID: 205913_at
tgtagagccagctgcttgctcacag

SEQ ID NO: 4095 - DNA, 25 bp, Artificial sequence
  Affy probe set ID: 205913_at
catttgcatcattactgccttcacc

SEQ ID NO: 4096 - DNA, 25 bp, Artificial sequence
  Affy probe set ID: 205913_at
gcaaaaggatgtgtgtctttctccc

SEQ ID NO: 4097 - DNA, 25 bp, Artificial sequence
  Affy probe set ID: 205913_at
tgttccccttcattgaaaaccacca

SEQ ID NO: 4098 - DNA, 25 bp, Artificial sequence
  Affy probe set ID: 205913_at
ttgaaaaccaccacggtgccatctc

SEQ ID NO: 4099 - DNA, 25 bp, Artificial sequence
  Affy probe set ID: 205913_at
gtgccatctcttgtgtatgcagggc

SEQ ID NO: 4100 - DNA, 25 bp, Artificial sequence
  Affy probe set ID: 205913_at
ctatgcacctgcaggcacgtgtgta

SEQ ID NO: 4101 - DNA, 25 bp, Artificial sequence
  Affy probe set ID: 205913_at
cactccccgcttgtgtttacacaag

SEQ ID NO: 4102 - DNA, 25 bp, Artificial sequence
  Affy probe set ID: 205913_at
aagctgtggggtgttacgcatgcct

SEQ ID NO: 4103 - DNA, 25 bp, Artificial sequence
  Affy probe set ID: 205913_at
tcgctctttttgatggccacataat

SEQ ID NO: 4104 - DNA, 557 bp, Artificial sequence
  Target_Sequence, Fragment of GenBank Accession No. NM_000459
ctgtttccctttcactggcatgggagacccttgacaactgctgagaaaacatgcctctgccaaaggatgtgatatataagtgtacatatgtgctggaattctaacaagtcataggttaatatttaagacactgaaaaatctaagtgatataaatcagattcttctctctcattttatccctcacctgtagcatgccagtcccgtttcatttagtcatgtgaccactctgtcttgtgtttccacagcctgcaagttcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcat

SEQ ID NO: 4105 - DNA, 25 bp, Artificial sequence
  Affy probe set ID: 206702_at
ctgtttccctttcactggcatggga

SEQ ID NO: 4106 - DNA, 25 bp, Artificial sequence
  Affy probe set ID: 206702_at
ggcatgggagacccttgacaactgc

SEQ ID NO: 4107 - DNA, 25 bp, Artificial sequence
  Affy probe set ID: 206702_at
aactgctgagaaaacatgcctctgc

SEQ ID NO: 4108 - DNA, 25 bp, Artificial sequence
  Affy probe set ID: 206702_at
tagtcatgtgaccactctgtcttgt

SEQ ID NO: 4109 - DNA, 25 bp, Artificial sequence
  Affy probe set ID: 206702_at
tttccacagcctgcaagttcagtcc

SEQ ID NO: 4110 - DNA, 25 bp, Artificial sequence
  Affy probe set ID: 206702_at
agttcagtccaggatgctaacatct

SEQ ID NO: 4111 - DNA, 25 bp, Artificial sequence
  Affy probe set ID: 206702_at
cttaaatctcattgcttacaagcct

SEQ ID NO: 4112 - DNA, 25 bp, Artificial sequence
  Affy probe set ID: 206702_at
taatatccctacatgtattgcacat

SEQ ID NO: 4113 - DNA, 25 bp, Artificial sequence
  Affy probe set ID: 206702_at
gatgagttgtgagtttaccttgtat

SEQ ID NO: 4114 - DNA, 25 bp, Artificial sequence
  Affy probe set ID: 206702_at
taccttgtatactgtaggcacactt

SEQ ID NO: 4115 - DNA, 25 bp, Artificial sequence
  Affy probe set ID: 206702_at
ggcacactttgcactgatatatcat

SEQ ID NO: 4116 - DNA, 558 bp, Artificial sequence
  Target_Sequence, Fragment of GenBank Accession No. NM_004797
aaataacatacgcactcaacttccttttctttcttccttcctttctttcttccttcctttctttctctctctctctttccttccttccttcctccttttctctctctctctctctctctctcttttcttgacagactctcgttctgtggccctggctggagttcagtggtgtgatcttggctcactgctacctctaccatgagcaattctcctgcctcagcctcccaagtagctggaactacaggctcatgccactgcgcccagctaatttttgtatttttcgtagagacggggtttcaccacattcgtcaggttggtttcaaactcctgactttgtgatccacccgcctcggcctcccaaagtgctgggattacaggcatgagccatcacacctggtcaactttcttttgattagtgtttttgtggtatatctttttccatcatgttactttaaatatatctatattattgtatttaaaatgtgtttcttacagactgcatgtagttgggtataatttttatccagtctaaaaatatctgtcttttaattggtgttt

SEQ ID NO: 4117 - DNA, 25 bp, Artificial sequence
  Affy probe set ID: 207175_at
aaataacatacgcactcaacttcct

SEQ ID NO: 4118 - DNA, 25 bp, Artificial sequence
  Affy probe set ID: 207175_at
cttgacagactctcgttctgtggcc

SEQ ID NO: 4119 - DNA, 25 bp, Artificial sequence
  Affy probe set ID: 207175_at
actgctacctctaccatgagcaatt

SEQ ID NO: 4120 - DNA, 25 bp, Artificial sequence
  Affy probe set ID: 207175_at
acctctaccatgagcaattctcctg

SEQ ID NO: 4121 - DNA, 25 bp, Artificial sequence
  Affy probe set ID: 207175_at
tcaccacattcgtcaggttggtttc

SEQ ID NO: 4122 - DNA, 25 bp, Artificial sequence
  Affy probe set ID: 207175_at
catcacacctggtcaactttctttt

SEQ ID NO: 4123 - DNA, 25 bp, Artificial sequence
  Affy probe set ID: 207175_at
atatctttttccatcatgttacttt

SEQ ID NO: 4124 - DNA, 25 bp, Artificial sequence
  Affy probe set ID: 207175_at
aatgtgtttcttacagactgcatgt

SEQ ID NO: 4125 - DNA, 25 bp, Artificial sequence
  Affy probe set ID: 207175_at
acagactgcatgtagttgggtataa

SEQ ID NO: 4126 - DNA, 25 bp, Artificial sequence
  Affy probe set ID: 207175_at
gttgggtataatttttatccagtct

SEQ ID NO: 4127 - DNA, 25 bp, Artificial sequence
  Affy probe set ID: 207175_at
aatatctgtcttttaattggtgttt

SEQ ID NO: 4128 - DNA, 493 bp, Artificial sequence
  Target_Sequence, Fragment of GenBank Accession No. NM_000442
  misc_feature (273)..(273): n is a, c, g, or t
  misc_feature (408)..(408): n is a, c, g, or t
  misc_feature (410)..(410): n is a, c, g, or t
gaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggntagtccttgttctttggaaatacacagtgctgaccagacagcctccccctgtcccctctatgacctcgccctccacaaatgggaaaaccagactacttgggagcaccgcctgtgaaataccaacctgaagacacngnttcattcaggcaacgcacaaaacagaaaatgaaggtggaacaagcacagatgttcttcaactgtttttgtctacactctttct

SEQ ID NO: 4129 - DNA, 25 bp, Artificial sequence
  Affy probe set ID: 208981_at
gaggggctgttgaatttcccacata

SEQ ID NO: 4130 - DNA, 25 bp, Artificial sequence
  Affy probe set ID: 208981_at
ggagatccagggcaaggccattggg

SEQ ID NO: 4131 - DNA, 25 bp, Artificial sequence
  Affy probe set ID: 208981_at
agataaagaccttttccatgcaccc

SEQ ID NO: 4132 - DNA, 25 bp, Artificial sequence
  Affy probe set ID: 208981_at
gcaccctcatacacagaaaccaatt

SEQ ID NO: 4133 - DNA, 25 bp, Artificial sequence
  Affy probe set ID: 208981_at
ttatactcaatcatttctagcgcat

SEQ ID NO: 4134 - DNA, 25 bp, Artificial sequence
  Affy probe set ID: 208981_at
atttctagcgcatggcctggttaga

SEQ ID NO: 4135 - DNA, 25 bp, Artificial sequence
  Affy probe set ID: 208981_at
tctcttttcctttggtccttcaaag

SEQ ID NO: 4136 - DNA, 25 bp, Artificial sequence
  Affy probe set ID: 208981_at
ggagcaccgcctgtgaaataccaac

SEQ ID NO: 4137 - DNA, 25 bp, Artificial sequence
  Affy probe set ID: 208981_at
ttcattcaggcaacgcacaaaacag

SEQ ID NO: 4138 - DNA, 25 bp, Artificial sequence
  Affy probe set ID: 208981_at
agatgttcttcaactgtttttgtct

SEQ ID NO: 4139 - DNA, 25 bp, Artificial sequence
  Affy probe set ID: 208981_at
aactgtttttgtctacactctttct

SEQ ID NO: 4140 - DNA, 480 bp, Artificial sequence
  Target_Sequence, Fragment of GenBank Accession No. NM_198098
  misc_feature (431)..(431): n is a, c, g, or t
gaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttntaggctgctgcacaccaaggccctgcatctgtctgctctgcatatatgt

SEQ ID NO: 4141 - DNA, 25 bp, Artificial sequence
  Affy probe set ID: 209047_at
gaaggctggattctatctacataag

SEQ ID NO: 4142 - DNA, 25 bp, Artificial sequence
  Affy probe set ID: 209047_at
cataagtcctttcaattccaccagg

SEQ ID NO: 4143 - DNA, 25 bp, Artificial sequence
  Affy probe set ID: 209047_at
caccactgtgcacttagccatgatg

SEQ ID NO: 4144 - DNA, 25 bp, Artificial sequence
  Affy probe set ID: 209047_at
gcccttaactatcaccagtgcatca

SEQ ID NO: 4145 - DNA, 25 bp, Artificial sequence
  Affy probe set ID: 209047_at
cagtgcatcacatctgcacactctc

SEQ ID NO: 4146 - DNA, 25 bp, Artificial sequence
  Affy probe set ID: 209047_at
gcaggaacttctagctcatttaaca

SEQ ID NO: 4147 - DNA, 25 bp, Artificial sequence
  Affy probe set ID: 209047_at
gctagacaatgatttggccaggcct

SEQ ID NO: 4148 - DNA, 25 bp, Artificial sequence
  Affy probe set ID: 209047_at
ggcctagtaaccaaggccctgtctc

SEQ ID NO: 4149 - DNA, 25 bp, Artificial sequence
  Affy probe set ID: 209047_at
accacgaggctgattcctctcattt

SEQ ID NO: 4150 - DNA, 25 bp, Artificial sequence
  Affy probe set ID: 209047_at
tctcagtttctgcctgggcaatggc

SEQ ID NO: 4151 - DNA, 25 bp, Artificial sequence
  Affy probe set ID: 209047_at
gcatctgtctgctctgcatatatgt

SEQ ID NO: 4152 - DNA, 435 bp, Artificial sequence
  Target_Sequence, Fragment of GenBank Accession No. NM_021005
aaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaag

SEQ ID NO: 4153 - DNA, 25 bp, Artificial sequence
  Affy probe set ID: 209120_at
aaagaaaccatgacaaacctagctt

SEQ ID NO: 4154 - DNA, 25 bp, Artificial sequence
  Affy probe set ID: 209120_at
agacacatgctgaggttttgaataa

SEQ ID NO: 4155 - DNA, 25 bp, Artificial sequence
  Affy probe set ID: 209120_at
tgtaatttgaattgggtcccgctta

SEQ ID NO: 4156 - DNA, 25 bp, Artificial sequence
  Affy probe set ID: 209120_at
gtcccgcttagttcttgaattgtta

SEQ ID NO: 4157 - DNA, 25 bp, Artificial sequence
  Affy probe set ID: 209120_at
gtatatttgcaaaccctttgtatta

SEQ ID NO: 4158 - DNA, 25 bp, Artificial sequence
  Affy probe set ID: 209120_at
cactgttggcacttataggtaacgt

SEQ ID NO: 4159 - DNA, 25 bp, Artificial sequence
  Affy probe set ID: 209120_at
gtaacgtgattgattcagtatctta

SEQ ID NO: 4160 - DNA, 25 bp, Artificial sequence
  Affy probe set ID: 209120_at
tatcttagagtttacagtttgtgtt

SEQ ID NO: 4161 - DNA, 25 bp, Artificial sequence
  Affy probe set ID: 209120_at
taagtgcaacatttctgtatactgt

SEQ ID NO: 4162 - DNA, 25 bp, Artificial sequence
  Affy probe set ID: 209120_at
aactgaactgtttggtcgagtcttt

SEQ ID NO: 4163 - DNA, 25 bp, Artificial sequence
  Affy probe set ID: 209120_at
gagtctttgtgtgttatattccaag

SEQ ID NO: 4164 - DNA, 379 bp, Artificial sequence
  Target_Sequence, Fragment of GenBank Accession No. NM_014220
gttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctca

SEQ ID NO: 4165 - DNA, 25 bp, Artificial sequence
  Affy probe set ID: 209386_at
gttttcactgcttgtatgatgtttc

SEQ ID NO: 4166 - DNA, 25 bp, Artificial sequence
  Affy probe set ID: 209386_at
tgatgtttcccattcatacacctat

SEQ ID NO: 4167 - DNA, 25 bp, Artificial sequence
  Affy probe set ID: 209386_at
tcatacacctataaatctctaacaa

SEQ ID NO: 4168 - DNA, 25 bp, Artificial sequence
  Affy probe set ID: 209386_at
aagaggccctttgaactgccttgtg

SEQ ID NO: 4169 - DNA, 25 bp, Artificial sequence
  Affy probe set ID: 209386_at
aactgccttgtgttctgtgagaaac

SEQ ID NO: 4170 - DNA, 25 bp, Artificial sequence
  Affy probe set ID: 209386_at
gttccaatccaaatgaatgcatcac

SEQ ID NO: 4171 - DNA, 25 bp, Artificial sequence
  Affy probe set ID: 209386_at
aatgcatcacaacttacaatgctgc

SEQ ID NO: 4172 - DNA, 25 bp, Artificial sequence
  Affy probe set ID: 209386_at
atgctgctcattgttgtgagtacta

SEQ ID NO: 4173 - DNA, 25 bp, Artificial sequence
  Affy probe set ID: 209386_at
aaagccttttgtcctccaaagatga

SEQ ID NO: 4174 - DNA, 25 bp, Artificial sequence
  Affy probe set ID: 209386_at
ggggacgagtgacggcaggaggacc

SEQ ID NO: 4175 - DNA, 25 bp, Artificial sequence
  Affy probe set ID: 209386_at
ggaggaccacgaggaaataccctca

SEQ ID NO: 4176 - DNA, 486 bp, Artificial sequence
  Target_Sequence, Fragment of GenBank Accession No. NM_001001549
tgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgta

SEQ ID NO: 4177 - DNA, 25 bp, Artificial sequence
  Affy probe set ID: 209409_at
tgtatctctgcctgtgattttcttt

SEQ ID NO: 4178 - DNA, 25 bp, Artificial sequence
  Affy probe set ID: 209409_at
gaaactccatgtagcaaccaggacg

SEQ ID NO: 4179 - DNA, 25 bp, Artificial sequence
  Affy probe set ID: 209409_at
tgtgcctcagcctagatgttttgtc

SEQ ID NO: 4180 - DNA, 25 bp, Artificial sequence
  Affy probe set ID: 209409_at
ttctcttttctgcacttaatacctg

SEQ ID NO: 4181 - DNA, 25 bp, Artificial sequence
  Affy probe set ID: 209409_at
tgacagtatgaccgatctctgcgcc

SEQ ID NO: 4182 - DNA, 25 bp, Artificial sequence
  Affy probe set ID: 209409_at
cgcctttctgggggcgggcaagctg

SEQ ID NO: 4183 - DNA, 25 bp, Artificial sequence
  Affy probe set ID: 209409_at
gctggcggtagatttgtgatgtcac

SEQ ID NO: 4184 - DNA, 25 bp, Artificial sequence
  Affy probe set ID: 209409_at
aacctttattccatgtgctttgctt

SEQ ID NO: 4185 - DNA, 25 bp, Artificial sequence
  Affy probe set ID: 209409_at
cttcattctgtacatagctctttgg

SEQ ID NO: 4186 - DNA, 25 bp, Artificial sequence
  Affy probe set ID: 209409_at
agctctttggctcgtgaacctaatt

SEQ ID NO: 4187 - DNA, 25 bp, Artificial sequence
  Affy probe set ID: 209409_at
agggactgatgttctgtttcttgta

SEQ ID NO: 4188 - DNA, 340 bp, Artificial sequence
  Target_Sequence, Fragment of GenBank Accession No. NM_006108
  misc_feature (208)..(208): n is a, c, g, or t
  misc_feature (262)..(262): n is a, c, g, or t
ttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaangtcctcatgtagaagcacccacttttgcaatgttgttctaagctatctatctanctctcagcccatgataaagttccttaagctggtgattcctaatcaaggacaagccaccctagtgtctcatgtttgtat

SEQ ID NO: 4189 - DNA, 25 bp, Artificial sequence
  Affy probe set ID: 209436_at
ttcttttttatattgtcctccacct

SEQ ID NO: 4190 - DNA, 25 bp, Artificial sequence
  Affy probe set ID: 209436_at
aagatagggcttttgctcccttgtt

SEQ ID NO: 4191 - DNA, 25 bp, Artificial sequence
  Affy probe set ID: 209436_at
gctcccttgttcttggagggaccat

SEQ ID NO: 4192 - DNA, 25 bp, Artificial sequence
  Affy probe set ID: 209436_at
agggaccattattacatctctgaac

SEQ ID NO: 4193 - DNA, 25 bp, Artificial sequence
  Affy probe set ID: 209436_at
atctctgaactacctttgtatccaa

SEQ ID NO: 4194 - DNA, 25 bp, Artificial sequence
  Affy probe set ID: 209436_at
ccttaaatgaattgctttctcccaa

SEQ ID NO: 4195 - DNA, 25 bp, Artificial sequence
  Affy probe set ID: 209436_at
gaagcacccacttttgcaatgttgt

SEQ ID NO: 4196 - DNA, 25 bp, Artificial sequence
  Affy probe set ID: 209436_at
gcaatgttgttctaagctatctatc

SEQ ID NO: 4197 - DNA, 25 bp, Artificial sequence
  Affy probe set ID: 209436_at
ctctcagcccatgataaagttcctt

SEQ ID NO: 4198 - DNA, 25 bp, Artificial sequence
  Affy probe set ID: 209436_at
atcaaggacaagccaccctagtgtc

SEQ ID NO: 4199 - DNA, 25 bp, Artificial sequence
  Affy probe set ID: 209436_at
ccaccctagtgtctcatgtttgtat

SEQ ID NO: 4200 - DNA, 492 bp, Artificial sequence
  Target_Sequence, Fragment of GenBank Accession No. NM_001003679
ggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttttttgcatttgttttttcaatgtgtttacattgtatgaattgagctttttgcccacagattcttgatttgtagttgtttggcagga

SEQ ID NO: 4201 - DNA, 25 bp, Artificial sequence
  Affy probe set ID: 209894_at
ggcataggaacagttttctcttcat

SEQ ID NO: 4202 - DNA, 25 bp, Artificial sequence
  Affy probe set ID: 209894_at
aattcagtatttgtcattatgcagt

SEQ ID NO: 4203 - DNA, 25 bp, Artificial sequence
  Affy probe set ID: 209894_at
atacctacataagtctattccatta

SEQ ID NO: 4204 - DNA, 25 bp, Artificial sequence
  Affy probe set ID: 209894_at
ttttgcgcttggcatatttattcct

SEQ ID NO: 4205 - DNA, 25 bp, Artificial sequence
  Affy probe set ID: 209894_at
agctgggtataccattatttcaagt

SEQ ID NO: 4206 - DNA, 25 bp, Artificial sequence
  Affy probe set ID: 209894_at
gaacacattttctatagcccttaat

SEQ ID NO: 4207 - DNA, 25 bp, Artificial sequence
  Affy probe set ID: 209894_at
tatagcccttaatttagttgtgtta

SEQ ID NO: 4208 - DNA, 25 bp, Artificial sequence
  Affy probe set ID: 209894_at
ggtgatgtatcaacagctttttttt

SEQ ID NO: 4209 - DNA, 25 bp, Artificial sequence
  Affy probe set ID: 209894_at
gtatgaattgagctttttgcccaca

SEQ ID NO: 4210 - DNA, 25 bp, Artificial sequence
  Affy probe set ID: 209894_at
ttttgcccacagattcttgatttgt

SEQ ID NO: 4211 - DNA, 25 bp, Artificial sequence
  Affy probe set ID: 209894_at
cttgatttgtagttgtttggcagga

SEQ ID NO: 4212 - DNA, 198 bp, Artificial sequence
  Target_Sequence, Fragment of GenBank Accession No. NM_000599
tcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcc

SEQ ID NO: 4213 - DNA, 25 bp, Artificial sequence
  Affy probe set ID: 211959_at
tcacaccgtagcccacatggatagc

SEQ ID NO: 4214 - DNA, 25 bp, Artificial sequence
  Affy probe set ID: 211959_at
acaccgtagcccacatggatagcac

SEQ ID NO: 4215 - DNA, 25 bp, Artificial sequence
  Affy probe set ID: 211959_at
cttcagattccgagttgcctaccgg

SEQ ID NO: 4216 - DNA, 25 bp, Artificial sequence
  Affy probe set ID: 211959_at
cagattccgagttgcctaccggttg

SEQ ID NO: 4217 - DNA, 25 bp, Artificial sequence
  Affy probe set ID: 211959_at
gaagacagcaataaccacagtacat

SEQ ID NO: 4218 - DNA, 25 bp, Artificial sequence
  Affy probe set ID: 211959_at
agcaataaccacagtacatattact

SEQ ID NO: 4219 - DNA, 25 bp, Artificial sequence
  Affy probe set ID: 211959_at
agtacatattactgtagttctctat

SEQ ID NO: 4220 - DNA, 25 bp, Artificial sequence
  Affy probe set ID: 211959_at
gtagttctctatagttttacataca

SEQ ID NO: 4221 - DNA, 25 bp, Artificial sequence
  Affy probe set ID: 211959_at
tctctatagttttacatacattcat

SEQ ID NO: 4222 - DNA, 25 bp, Artificial sequence
  Affy probe set ID: 211959_at
attcataccataactctgttctctc

SEQ ID NO: 4223 - DNA, 25 bp, Artificial sequence
  Affy probe set ID: 211959_at
ttcataccataactctgttctctcc

SEQ ID NO: 4224 - DNA, 541 bp, Artificial sequence
  Target_Sequence, Fragment of GenBank Accession No. NM_001753
  misc_feature (54)..(54): n is a, c, g, or t
  misc_feature (91)..(91): n is a, c, g, or t
  misc_feature (99)..(99): n is a, c, g, or t
  misc_feature (106)..(106): n is a, c, g, or t
  misc_feature (110)..(110): n is a, c, g, or t
  misc_feature (136)..(136): n is a, c, g, or t
  misc_feature (151)..(151): n is a, c, g, or t
gaatttcacctgtaaacctgagtcgtacagaaagctgcctggtatatccaaaangctttttattcctcctgctcatattgtgattctgccntttggggnacttttncttnaaaccttcagttatgatttttttttncatacacttattggnaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataa

SEQ ID NO: 4225 - DNA, 25 bp, Artificial sequence
  Affy probe set ID: 212097_at
gaatttcacctgtaaacctgagtcg

SEQ ID NO: 4226 - DNA, 25 bp, Artificial sequence
  Affy probe set ID: 212097_at
cagaaagctgcctggtatatccaaa

SEQ ID NO: 4227 - DNA, 25 bp, Artificial sequence
  Affy probe set ID: 212097_at
tattcctcctgctcatattgtgatt

SEQ ID NO: 4228 - DNA, 25 bp, Artificial sequence
  Affy probe set ID: 212097_at
gtcttcctgacactttaattaccaa

SEQ ID NO: 4229 - DNA, 25 bp, Artificial sequence
  Affy probe set ID: 212097_at
taccaacctgttacctactttgact

SEQ ID NO: 4230 - DNA, 25 bp, Artificial sequence
  Affy probe set ID: 212097_at
gttacctactttgactttttgcatt

SEQ ID NO: 4231 - DNA, 25 bp, Artificial sequence
  Affy probe set ID: 212097_at
atgtgctatactgcatactttttaa

SEQ ID NO: 4232 - DNA, 25 bp, Artificial sequence
  Affy probe set ID: 212097_at
aactgtgtattccaagacatgtctg

SEQ ID NO: 4233 - DNA, 25 bp, Artificial sequence
  Affy probe set ID: 212097_at
catagatgcttagtccctcatgcaa

SEQ ID NO: 4234 - DNA, 25 bp, Artificial sequence
  Affy probe set ID: 212097_at
aattttttatcatgcatgtcctgta

SEQ ID NO: 4235 - DNA, 25 bp, Artificial sequence
  Affy probe set ID: 212097_at
taaaggttacaagcctgcacaataa

SEQ ID NO: 4236 - DNA, 328 bp, Artificial sequence
  Target_Sequence, Fragment of GenBank Accession No. NM_005841
taattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtgg

SEQ ID NO: 4237 - DNA, 25 bp, Artificial sequence
  Affy probe set ID: 212558_at
taattttagattcgccttacaatgt

SEQ ID NO: 4238 - DNA, 25 bp, Artificial sequence
  Affy probe set ID: 212558_at
taatattggttggaccttgcccatc

SEQ ID NO: 4239 - DNA, 25 bp, Artificial sequence
  Affy probe set ID: 212558_at
cttcactctagccttcgtatttgtg

SEQ ID NO: 4240 - DNA, 25 bp, Artificial sequence
  Affy probe set ID: 212558_at
cccatgcttctcaccaaatttttgt

SEQ ID NO: 4241 - DNA, 25 bp, Artificial sequence
  Affy probe set ID: 212558_at
ttgtcattgagggcacttggataac

SEQ ID NO: 4242 - DNA, 25 bp, Artificial sequence
  Affy probe set ID: 212558_at
gtgtcacagaactatgctgcctaaa

SEQ ID NO: 4243 - DNA, 25 bp, Artificial sequence
  Affy probe set ID: 212558_at
tgcctaaagtgatcttggctcctta

SEQ ID NO: 4244 - DNA, 25 bp, Artificial sequence
  Affy probe set ID: 212558_at
ttggctccttaatggtccttttggc

SEQ ID NO: 4245 - DNA, 25 bp, Artificial sequence
  Affy probe set ID: 212558_at
ttggccccttggatagttaacagct

SEQ ID NO: 4246 - DNA, 25 bp, Artificial sequence
  Affy probe set ID: 212558_at
acagctgagtaattctaatctcttc

SEQ ID NO: 4247 - DNA, 25 bp, Artificial sequence
  Affy probe set ID: 212558_at
tccttgccttaaccacaaattgtgg

SEQ ID NO: 4248 - DNA, 395 bp, Artificial sequence
  Target_Sequence, Fragment of GenBank Accession No. NM_015345
gctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccc

SEQ ID NO: 4249 - DNA, 25 bp, Artificial sequence
  Affy probe set ID: 212793_at
gctctggtgctagatgccactgtag

SEQ ID NO: 4250 - DNA, 25 bp, Artificial sequence
  Affy probe set ID: 212793_at
gatctccaacagtgccttggaccat

SEQ ID NO: 4251 - DNA, 25 bp, Artificial sequence
  Affy probe set ID: 212793_at
tggaccatggactcatactcaactg

SEQ ID NO: 4252 - DNA, 25 bp, Artificial sequence
  Affy probe set ID: 212793_at
gtggctgagctggtccttaataggt

SEQ ID NO: 4253 - DNA, 25 bp, Artificial sequence
  Affy probe set ID: 212793_at
ataggttgtttcttggtcttgcttt

SEQ ID NO: 4254 - DNA, 25 bp, Artificial sequence
  Affy probe set ID: 212793_at
gctcctgccacctttagataagttt

SEQ ID NO: 4255 - DNA, 25 bp, Artificial sequence
  Affy probe set ID: 212793_at
agtttctctagctaattttgtggcc

SEQ ID NO: 4256 - DNA, 25 bp, Artificial sequence
  Affy probe set ID: 212793_at
aattcgtcatcaacctaacaaacac

SEQ ID NO: 4257 - DNA, 25 bp, Artificial sequence
  Affy probe set ID: 212793_at
taacaaacacaaccttctcagcagc

SEQ ID NO: 4258 - DNA, 25 bp, Artificial sequence
  Affy probe set ID: 212793_at
aatggggaagggtctgttccagcct

SEQ ID NO: 4259 - DNA, 25 bp, Artificial sequence
  Affy probe set ID: 212793_at
gggaactgtgactatctatctcccc

SEQ ID NO: 4260 - DNA, 554 bp, Artificial sequence
  Target_Sequence, Fragment of GenBank Accession No. NM_015234
  misc_feature (203)..(203): n is a, c, g, or t
tgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattanaaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaa

SEQ ID NO: 4261 - DNA, 25 bp, Artificial sequence
  Affy probe set ID: 212950_at
tgggcagtatcttcctgatgtcttc

SEQ ID NO: 4262 - DNA, 25 bp, Artificial sequence
  Affy probe set ID: 212950_at
tcctgatgtcttcttagctaagagg

SEQ ID NO: 4263 - DNA, 25 bp, Artificial sequence
  Affy probe set ID: 212950_at
aattccttcatcagaacgacttcaa

SEQ ID NO: 4264 - DNA, 25 bp, Artificial sequence
  Affy probe set ID: 212950_at
atatgatcctcctgagactaacttt

SEQ ID NO: 4265 - DNA, 25 bp, Artificial sequence
  Affy probe set ID: 212950_at
gatatacccttcaattgccaaattt

SEQ ID NO: 4266 - DNA, 25 bp, Artificial sequence
  Affy probe set ID: 212950_at
tgttgcactgaagacagaccctgtc

SEQ ID NO: 4267 - DNA, 25 bp, Artificial sequence
  Affy probe set ID: 212950_at
gaccctgtcatatatttaatggctt

SEQ ID NO: 4268 - DNA, 25 bp, Artificial sequence
  Affy probe set ID: 212950_at
gcttcaagcaggtacttctctgtgc

SEQ ID NO: 4269 - DNA, 25 bp, Artificial sequence
  Affy probe set ID: 212950_at
tattgtggatactggcccttggtgt

SEQ ID NO: 4270 - DNA, 25 bp, Artificial sequence
  Affy probe set ID: 212950_at
tgtttccatctttaagttcccagac

SEQ ID NO: 4271 - DNA, 25 bp, Artificial sequence
  Affy probe set ID: 212950_at
aagttcccagaccaatatacattaa

SEQ ID NO: 4272 - DNA, 285 bp, Artificial sequence
  Target_Sequence, Fragment of GenBank Accession No. NM_006108
gaaatttgtttggacttccacttgagacagtaaagagagtattagacacccagtaaaaactgccatataaagaagttgtaattgtttgttgtgtatgtatttttttcaatgccaaaccagctgtgatccaatttacatccacattttaggtccaacagcaagaagttcagagagagatttcccaaccagacattgggtcactcactggtcaccttgccagtgcattttattagaagggaatctgttgtagcaaatgggaataaacctgggtttctatagacccag

SEQ ID NO: 4273 - DNA, 25 bp, Artificial sequence
  Affy probe set ID: 213993_at
gaaatttgtttggacttccacttga

SEQ ID NO: 4274 - DNA, 25 bp, Artificial sequence
  Affy probe set ID: 213993_at
ccaatttacatccacattttaggtc

SEQ ID NO: 4275 - DNA, 25 bp, Artificial sequence
  Affy probe set ID: 213993_at
acatccacattttaggtccaacagc

SEQ ID NO: 4276 - DNA, 25 bp, Artificial sequence
  Affy probe set ID: 213993_at
ggtccaacagcaagaagttcagaga

SEQ ID NO: 4277 - DNA, 25 bp, Artificial sequence
  Affy probe set ID: 213993_at
gagagagatttcccaaccagacatt

SEQ ID NO: 4278 - DNA, 25 bp, Artificial sequence
  Affy probe set ID: 213993_at
caaccagacattgggtcactcactg

SEQ ID NO: 4279 - DNA, 25 bp, Artificial sequence
  Affy probe set ID: 213993_at
agacattgggtcactcactggtcac

SEQ ID NO: 4280 - DNA, 25 bp, Artificial sequence
  Affy probe set ID: 213993_at
caccttgccagtgcattttattaga

SEQ ID NO: 4281 - DNA, 25 bp, Artificial sequence
  Affy probe set ID: 213993_at
agaagggaatctgttgtagcaaatg

SEQ ID NO: 4282 - DNA, 25 bp, Artificial sequence
  Affy probe set ID: 213993_at
gtagcaaatgggaataaacctgggt

SEQ ID NO: 4283 - DNA, 25 bp, Artificial sequence
  Affy probe set ID: 213993_at
taaacctgggtttctatagacccag

SEQ ID NO: 4284 - DNA, 395 bp, Artificial sequence
  Target_Sequence, Fragment of GenBank Accession No. NM_016215
atcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcaggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccagg

SEQ ID NO: 4285 - DNA, 25 bp, Artificial sequence
  Affy probe set ID: 218825_at
atcgactccctgagcgagcagattt

SEQ ID NO: 4286 - DNA, 25 bp, Artificial sequence
  Affy probe set ID: 218825_at
cctgagcgagcagatttccttcctg

SEQ ID NO: 4287 - DNA, 25 bp, Artificial sequence
  Affy probe set ID: 218825_at
ggtcctgctcctgcaagaaagactc

SEQ ID NO: 4288 - DNA, 25 bp, Artificial sequence
  Affy probe set ID: 218825_at
gcaagaaagactcgtgactgcccag

SEQ ID NO: 4289 - DNA, 25 bp, Artificial sequence
  Affy probe set ID: 218825_at
ctgcccaacatgctgggggtccaga

SEQ ID NO: 4290 - DNA, 25 bp, Artificial sequence
  Affy probe set ID: 218825_at
catgctgggggtccagaagccacct

SEQ ID NO: 4291 - DNA, 25 bp, Artificial sequence
  Affy probe set ID: 218825_at
tccagaagccacctcggggtgactg

SEQ ID NO: 4292 - DNA, 25 bp, Artificial sequence
  Affy probe set ID: 218825_at
ccacctcggggtgactgagcggaag

SEQ ID NO: 4293 - DNA, 25 bp, Artificial sequence
  Affy probe set ID: 218825_at
cggggtgactgagcggaaggccagg

SEQ ID NO: 4294 - DNA, 25 bp, Artificial sequence
  Affy probe set ID: 218825_at
tgagggaaggtacgagctccctgct

SEQ ID NO: 4295 - DNA, 25 bp, Artificial sequence
  Affy probe set ID: 218825_at
cctgggacccatggcacaggccagg

SEQ ID NO: 4296 - DNA, 475 bp, Artificial sequence
  Target_Sequence, Fragment of GenBank Accession No. NM_022481
acatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagta

SEQ ID NO: 4297 - DNA, 25 bp, Artificial sequence
  Affy probe set ID: 218950_at
acatgaccctaggaccagcagtctg

SEQ ID NO: 4298 - DNA, 25 bp, Artificial sequence
  Affy probe set ID: 218950_at
gacccagaaactcttatcgtggcac

SEQ ID NO: 4299 - DNA, 25 bp, Artificial sequence
  Affy probe set ID: 218950_at
cttatcgtggcactgttgcagcttc

SEQ ID NO: 4300 - DNA, 25 bp, Artificial sequence
  Affy probe set ID: 218950_at
ctaaaggcttcagtggctgcgtgtc

SEQ ID NO: 4301 - DNA, 25 bp, Artificial sequence
  Affy probe set ID: 218950_at
cccagcccatttatctataccatga

SEQ ID NO: 4302 - DNA, 25 bp, Artificial sequence
  Affy probe set ID: 218950_at
gtttcttagagccataagccccaca

SEQ ID NO: 4303 - DNA, 25 bp, Artificial sequence
  Affy probe set ID: 218950_at
ccccacatattatccctgaacaagg

SEQ ID NO: 4304 - DNA, 25 bp, Artificial sequence
  Affy probe set ID: 218950_at
gaacaagggcagctcctgctttata

SEQ ID NO: 4305 - DNA, 25 bp, Artificial sequence
  Affy probe set ID: 218950_at
gatgttaaagtctatcctgtcccac

SEQ ID NO: 4306 - DNA, 25 bp, Artificial sequence
  Affy probe set ID: 218950_at
ccacttcctacattctgggactacc

SEQ ID NO: 4307 - DNA, 25 bp, Artificial sequence
  Affy probe set ID: 218950_at
tgggactaccgtgaagcctggagta

SEQ ID NO: 4308 - DNA, 523 bp, Artificial sequence
  Target_Sequence, Fragment of GenBank Accession No. XM_371262
aatgactcatcaaattatccaattattaactactagacaaaaagtattttaaatcagtttttctgtttatgctataggaactgtagataataaggtaaaattatgtatcatatagatatactatgtttttctatgtgaaatagttctgtcaaaaatagtattgcagatatttggaaagtaattggtttctcaggagtgatatcactgcacccaaggaaagattttctttctaacacgagaagtatatgaatgtcctgaaggaaaccactggcttgatatttctgtgactcgtgttgcctttgaaactagtcccctaccacctcggtaatgagctccattacagaaagtggaacataagagaatgaaggggcagaatatcaaacagtgaaaagggaatgataagatgtattttgaatgaactgttttttctgtagactagctgagaaattgttgacataaaataaagaattgaagaaacacattttaccattttgtgaattgttctgaacttaaatgtccacta

SEQ ID NO: 4309 - DNA, 25 bp, Artificial sequence
  Affy probe set ID: 219134_at
aatgactcatcaaattatccaatta

SEQ ID NO: 4310 - DNA, 25 bp, Artificial sequence
  Affy probe set ID: 219134_at
gtttttctgtttatgctataggaac

SEQ ID NO: 4311 - DNA, 25 bp, Artificial sequence
  Affy probe set ID: 219134_at
aagtaattggtttctcaggagtgat

SEQ ID NO: 4312 - DNA, 25 bp, Artificial sequence
  Affy probe set ID: 219134_at
gagtgatatcactgcacccaaggaa

SEQ ID NO: 4313 - DNA, 25 bp, Artificial sequence
  Affy probe set ID: 219134_at
gaatgtcctgaaggaaaccactggc

SEQ ID NO: 4314 - DNA, 25 bp, Artificial sequence
  Affy probe set ID: 219134_at
accactggcttgatatttctgtgac

SEQ ID NO: 4315 - DNA, 25 bp, Artificial sequence
  Affy probe set ID: 219134_at
tgtgactcgtgttgcctttgaaact

SEQ ID NO: 4316 - DNA, 25 bp, Artificial sequence
  Affy probe set ID: 219134_at
tgttgcctttgaaactagtccccta

SEQ ID NO: 4317 - DNA, 25 bp, Artificial sequence
  Affy probe set ID: 219134_at
taccacctcggtaatgagctccatt

SEQ ID NO: 4318 - DNA, 25 bp, Artificial sequence
  Affy probe set ID: 219134_at
gaactgttttttctgtagactagct

SEQ ID NO: 4319 - DNA, 25 bp, Artificial sequence
  Affy probe set ID: 219134_at
ttgttctgaacttaaatgtccacta

SEQ ID NO: 4320 - DNA, 428 bp, Artificial sequence
  Target_Sequence, Fragment of GenBank Accession No. NM_016563
gtgtcaccgcagcttataccaagacaccatggctcagacatgggatcaggacacacctttgagatcccactgttagcaagaaaaggctgtccaaggcaggcagtgtggtagttgtctgattttgtttaccacacgccaggtcccagggaagtcttgcacagactcttagcagacaagcagggaaaagagagggtcctggtgggtggaaggattgggaaggggattctgggcctggaagcctgctccttcccctctcagccgtctcaggactactgttggattgcaaacagcatctctgacccagtcttcggactcattctgtaaatggaggagctgaggtcagaggggggctgtgaactactcaagaccacatgcttgcagtcctacaggcttcccgacccacaggccagctacggattttgcacttt

SEQ ID NO: 4321 - DNA, 25 bp, Artificial sequence
  Affy probe set ID: 219167_at
gtgtcaccgcagcttataccaagac

SEQ ID NO: 4322 - DNA, 25 bp, Artificial sequence
  Affy probe set ID: 219167_at
tcaggacacacctttgagatcccac

SEQ ID NO: 4323 - DNA, 25 bp, Artificial sequence
  Affy probe set ID: 219167_at
aaggctgtccaaggcaggcagtgtg

SEQ ID NO: 4324 - DNA, 25 bp, Artificial sequence
  Affy probe set ID: 219167_at
gtctgattttgtttaccacacgcca

SEQ ID NO: 4325 - DNA, 25 bp, Artificial sequence
  Affy probe set ID: 219167_at
acgccaggtcccagggaagtcttgc

SEQ ID NO: 4326 - DNA, 25 bp, Artificial sequence
  Affy probe set ID: 219167_at
gaaggggattctgggcctggaagcc

SEQ ID NO: 4327 - DNA, 25 bp, Artificial sequence
  Affy probe set ID: 219167_at
agccgtctcaggactactgttggat

SEQ ID NO: 4328 - DNA, 25 bp, Artificial sequence
  Affy probe set ID: 219167_at
gattgcaaacagcatctctgaccca

SEQ ID NO: 4329 - DNA, 25 bp, Artificial sequence
  Affy probe set ID: 219167_at
cccagtcttcggactcattctgtaa

SEQ ID NO: 4330 - DNA, 25 bp, Artificial sequence
  Affy probe set ID: 219167_at
caagaccacatgcttgcagtcctac

SEQ ID NO: 4331 - DNA, 25 bp, Artificial sequence
  Affy probe set ID: 219167_at
aggccagctacggattttgcacttt

SEQ ID NO: 4332 - DNA, 507 bp, Artificial sequence
  Target_Sequence, Fragment of GenBank Accession No. NM_006094
gctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttg

SEQ ID NO: 4333 - DNA, 25 bp, Artificial sequence
  Affy probe set ID: 224822_at
gctgccttccttaatattgcatctc

SEQ ID NO: 4334 - DNA, 25 bp, Artificial sequence
  Affy probe set ID: 224822_at
tcccacccttaaaaccacagattgc

SEQ ID NO: 4335 - DNA, 25 bp, Artificial sequence
  Affy probe set ID: 224822_at
gactgcaaatcattccaaggccaaa

SEQ ID NO: 4336 - DNA, 25 bp, Artificial sequence
  Affy probe set ID: 224822_at
aaggccaaactgcaactgagccacc

SEQ ID NO: 4337 - DNA, 25 bp, Artificial sequence
  Affy probe set ID: 224822_at
gagattctctccaacaaaggtccag

SEQ ID NO: 4338 - DNA, 25 bp, Artificial sequence
  Affy probe set ID: 224822_at
gcttgcaagcagagtcagggtcacc

SEQ ID NO: 4339 - DNA, 25 bp, Artificial sequence
  Affy probe set ID: 224822_at
tgccacaaaagttctctttcccact

SEQ ID NO: 4340 - DNA, 25 bp, Artificial sequence
  Affy probe set ID: 224822_at
tctgctgaggtcacttagagcgcca

SEQ ID NO: 4341 - DNA, 25 bp, Artificial sequence
  Affy probe set ID: 224822_at
ttagagcgccatcacaacttatttg

SEQ ID NO: 4342 - DNA, 25 bp, Artificial sequence
  Affy probe set ID: 224822_at
ttgagggcagggcttgtctcttaca

SEQ ID NO: 4343 - DNA, 25 bp, Artificial sequence
  Affy probe set ID: 224822_at
ccctgcagcggctttcagtattttg

SEQ ID NO: 4344 - DNA, 407 bp, Artificial sequence
  Target_Sequence, Fragment of GenBank Accession No. NM_019035
aaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccag

SEQ ID NO: 4345 - DNA, 25 bp, Artificial sequence
  Affy probe set ID: 225975_at
aaacagttgtgtcagtgtctctcct

SEQ ID NO: 4346 - DNA, 25 bp, Artificial sequence
  Affy probe set ID: 225975_at
tgtcagtgtctctcctaaggtagta

SEQ ID NO: 4347 - DNA, 25 bp, Artificial sequence
  Affy probe set ID: 225975_at
attgacttattctgaacccattcta

SEQ ID NO: 4348 - DNA, 25 bp, Artificial sequence
  Affy probe set ID: 225975_at
acccattctattttgaatctcccct

SEQ ID NO: 4349 - DNA, 25 bp, Artificial sequence
  Affy probe set ID: 225975_at
cctttcctctcacaatacttgaaca

SEQ ID NO: 4350 - DNA, 25 bp, Artificial sequence
  Affy probe set ID: 225975_at
tgtctccagtgcatgatctcatatt

SEQ ID NO: 4351 - DNA, 25 bp, Artificial sequence
  Affy probe set ID: 225975_at
tttattgtgctgtgatctctctgtg

SEQ ID NO: 4352 - DNA, 25 bp, Artificial sequence
  Affy probe set ID: 225975_at
tgctgtgatctctctgtgtggaatg

SEQ ID NO: 4353 - DNA, 25 bp, Artificial sequence
  Affy probe set ID: 225975_at
gaatgccttggtgagagagatgctt

SEQ ID NO: 4354 - DNA, 25 bp, Artificial sequence
  Affy probe set ID: 225975_at
tatcatttctgaccaagcttctatt

SEQ ID NO: 4355 - DNA, 25 bp, Artificial sequence
  Affy probe set ID: 225975_at
acactatcttgattgtactctccag

SEQ ID NO: 4356 - DNA, 507 bp, Artificial sequence
  Target_Sequence, Fragment of GenBank Accession No. NM_019055
  misc_feature (42)..(42): n is a, c, g, or t
gttctccctccacgattgtgaaaacaaatgaaaacaaaattngagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaag

SEQ ID NO: 4357 - DNA, 25 bp, Artificial sequence
  Affy probe set ID: 226028_at
gttctccctccacgattgtgaaaac

SEQ ID NO: 4358 - DNA, 25 bp, Artificial sequence
  Affy probe set ID: 226028_at
ctccctccacgattgtgaaaacaaa

SEQ ID NO: 4359 - DNA, 25 bp, Artificial sequence
  Affy probe set ID: 226028_at
caccaccaggttgttttggcctgag

SEQ ID NO: 4360 - DNA, 25 bp, Artificial sequence
  Affy probe set ID: 226028_at
ccaggttgttttggcctgaggagca

SEQ ID NO: 4361 - DNA, 25 bp, Artificial sequence
  Affy probe set ID: 226028_at
tcccccaccatttggatcacaggaa

SEQ ID NO: 4362 - DNA, 25 bp, Artificial sequence
  Affy probe set ID: 226028_at
gaatgccactgaggcactgaggccc

SEQ ID NO: 4363 - DNA, 25 bp, Artificial sequence
  Affy probe set ID: 226028_at
gctgggtctagcgaggatgctgaag

SEQ ID NO: 4364 - DNA, 25 bp, Artificial sequence
  Affy probe set ID: 226028_at
ggtctagcgaggatgctgaaggaag

SEQ ID NO: 4365 - DNA, 25 bp, Artificial sequence
  Affy probe set ID: 226028_at
agaccgtaggtcaaaagcaccatcc

SEQ ID NO: 4366 - DNA, 25 bp, Artificial sequence
  Affy probe set ID: 226028_at
catcctcgtactgttgtcactatga

SEQ ID NO: 4367 - DNA, 25 bp, Artificial sequence
  Affy probe set ID: 226028_at
gtactgttgtcactatgagcttaag

SEQ ID NO: 4368 - DNA, 544 bp, Artificial sequence
  Target_Sequence, Fragment of GenBank Accession No. NM_002207
  misc_feature (36)..(36): n is a, c, g, or t
  misc_feature (102)..(102): n is a, c, g, or t
  misc_feature (170)..(170): n is a, c, g, or t
ggattgtcacttggagcctttagtagacaaaaggcngaaagtgagcatcatttcagaaatgctttagtatgcacacttttagctgatattttgatatatagnataataatatacacagtggagaatattcaaagagtggctgaagggagaatacagagccagtagggccnaaaatgaaacttctaggatgtcttctgaattttcagcacatggggggaataagtgaacaaatttcccaacatcgtgcaatgctttatagcacaatgatctagatttcagactgtgttaaggttttttctttgttgatgttgttgttttaattctaatgtgcacggtgtgactggcagagtgagtttaaaagctttacgagtgattaattgcttggcaggcacccacgctatctgcatttccagaactttactgatgcatccatgtacatttccactgaggaattttggtgggtggggggaggttgtgctgcctcacaatgtcacgtgtattaaagtctaagcagtcacttctgattcacttgcactgtttggga

SEQ ID NO: 4369 - DNA, 25 bp, Artificial sequence
  Affy probe set ID: 227297_at
ggattgtcacttggagcctttagta

SEQ ID NO: 4370 - DNA, 25 bp, Artificial sequence
  Affy probe set ID: 227297_at
gtatgcacacttttagctgatattt

SEQ ID NO: 4371 - DNA, 25 bp, Artificial sequence
  Affy probe set ID: 227297_at
ggatgtcttctgaattttcagcaca

SEQ ID NO: 4372 - DNA, 25 bp, Artificial sequence
  Affy probe set ID: 227297_at
gaacaaatttcccaacatcgtgcaa

SEQ ID NO: 4373 - DNA, 25 bp, Artificial sequence
  Affy probe set ID: 227297_at
atgtgcacggtgtgactggcagagt

SEQ ID NO: 4374 - DNA, 25 bp, Artificial sequence
  Affy probe set ID: 227297_at
gattaattgcttggcaggcacccac

SEQ ID NO: 4375 - DNA, 25 bp, Artificial sequence
  Affy probe set ID: 227297_at
gaactttactgatgcatccatgtac

SEQ ID NO: 4376 - DNA, 25 bp, Artificial sequence
  Affy probe set ID: 227297_at
gcatccatgtacatttccactgagg

SEQ ID NO: 4377 - DNA, 25 bp, Artificial sequence
  Affy probe set ID: 227297_at
gctgcctcacaatgtcacgtgtatt

SEQ ID NO: 4378 - DNA, 25 bp, Artificial sequence
  Affy probe set ID: 227297_at
agcagtcacttctgattcacttgca

SEQ ID NO: 4379 - DNA, 25 bp, Artificial sequence
  Affy probe set ID: 227297_at
tctgattcacttgcactgtttggga

SEQ ID NO: 4380 - DNA, 175 bp, Artificial sequence
  Target_Sequence, Fragment of GenBank Accession No. XM_930608
caggctgagagctcacctgttcagcagagaagtggaactcactttgctcctggagcctgtctaccacagtgttatcagcttcattgtcatcctggtggttgtggtgatcatcctagttggtgtggtcagcctgaggttcaagtgtcggaagagcaaggagtctgaagatccccag

SEQ ID NO: 4381 - DNA, 25 bp, Artificial sequence
  Affy probe set ID: 227779_at
caggctgagagctcacctgttcagc

SEQ ID NO: 4382 - DNA, 25 bp, Artificial sequence
  Affy probe set ID: 227779_at
gagctcacctgttcagcagagaagt

SEQ ID NO: 4383 - DNA, 25 bp, Artificial sequence
  Affy probe set ID: 227779_at
ctgtctaccacagtgttatcagctt

SEQ ID NO: 4384 - DNA, 25 bp, Artificial sequence
  Affy probe set ID: 227779_at
gtgttatcagcttcattgtcatcct

SEQ ID NO: 4385 - DNA, 25 bp, Artificial sequence
  Affy probe set ID: 227779_at
tcatcctggtggttgtggtgatcat

SEQ ID NO: 4386 - DNA, 25 bp, Artificial sequence
  Affy probe set ID: 227779_at
ggtggttgtggtgatcatcctagtt

SEQ ID NO: 4387 - DNA, 25 bp, Artificial sequence
  Affy probe set ID: 227779_at
gatcatcctagttggtgtggtcagc

SEQ ID NO: 4388 - DNA, 25 bp, Artificial sequence
  Affy probe set ID: 227779_at
ctagttggtgtggtcagcctgaggt

SEQ ID NO: 4389 - DNA, 25 bp, Artificial sequence
  Affy probe set ID: 227779_at
gtcagcctgaggttcaagtgtcgga

SEQ ID NO: 4390 - DNA, 25 bp, Artificial sequence
  Affy probe set ID: 227779_at
tcaagtgtcggaagagcaaggagtc

SEQ ID NO: 4391 - DNA, 25 bp, Artificial sequence
  Affy probe set ID: 227779_at
gagcaaggagtctgaagatccccag

SEQ ID NO: 4392 - DNA, 479 bp, Artificial sequence
  Target_Sequence, Fragment of GenBank Accession No. XM_037493
  misc_feature (63)..(63): n is a, c, g, or t
  misc_feature (189)..(189): n is a, c, g, or t
  misc_feature (216)..(216): n is a, c, g, or t
  misc_feature (272)..(272): n is a, c, g, or t
  misc_feature (420)..(420): n is a, c, g, or t
tcctcacactcagcgatgacctgtggggtggggggccctgggacgtttttaaacctagggttnggagtctggactaagctccatccacgtcactcacaagtttctgtttatatttctagctttttttaataaaataaaaaaaaaaagaaaacagaagttttcacaacccaggggcctggcacgccggtntgtgcctgcccgccccgccctggcccnaccggccccactccctgggcacagagtcacacccactcatccttccgccaacagtncaggtcacacagcagcagtcactgtaacagactgccacatacacactcggtctcacactcacctgtgggttttggttccgttcaatttgggtttttaactttacagggtcagttccgcttcacctccttttgtatggagttccatccngggggtttcaccccctgctccagtcctgaggcctcctgaccctgacgttgtgatacgcc

SEQ ID NO: 4393 - DNA, 25 bp, Artificial sequence
  Affy probe set ID: 227923_at
tcctcacactcagcgatgacctgtg

SEQ ID NO: 4394 - DNA, 25 bp, Artificial sequence
  Affy probe set ID: 227923_at
cactcagcgatgacctgtggggtgg

SEQ ID NO: 4395 - DNA, 25 bp, Artificial sequence
  Affy probe set ID: 227923_at
ggagtctggactaagctccatccac

SEQ ID NO: 4396 - DNA, 25 bp, Artificial sequence
  Affy probe set ID: 227923_at
tccacgtcactcacaagtttctgtt

SEQ ID NO: 4397 - DNA, 25 bp, Artificial sequence
  Affy probe set ID: 227923_at
gtcactcacaagtttctgtttatat

SEQ ID NO: 4398 - DNA, 25 bp, Artificial sequence
  Affy probe set ID: 227923_at
gtcactgtaacagactgccacatac

SEQ ID NO: 4399 - DNA, 25 bp, Artificial sequence
  Affy probe set ID: 227923_at
tgtaacagactgccacatacacact

SEQ ID NO: 4400 - DNA, 25 bp, Artificial sequence
  Affy probe set ID: 227923_at
taactttacagggtcagttccgctt

SEQ ID NO: 4401 - DNA, 25 bp, Artificial sequence
  Affy probe set ID: 227923_at
ccgcttcacctccttttgtatggag

SEQ ID NO: 4402 - DNA, 25 bp, Artificial sequence
  Affy probe set ID: 227923_at
ttcacctccttttgtatggagttcc

SEQ ID NO: 4403 - DNA, 25 bp, Artificial sequence
  Affy probe set ID: 227923_at
cctgaccctgacgttgtgatacgcc

SEQ ID NO: 4404 - DNA, 339 bp, Artificial sequence
  Target_Sequence, Fragment of GenBank Accession No. NM_052954
aatagggttttctcatcttcaccatcaataaacatttattgcgtacctcctatattctgcaaattttccccaaatagaagccagttcagtccacaccatctcttctttgagttgtttatggcctcccttaaggcattttacaaacccataagcctacaatagatgagtatttttactatttgtattaagtgtcataatagcatcaatgtgcacattaccagtatagactgttggagttcactgattgttttcatagatgatgcttcttggggaaaaatagtataggatgtgaaagttttgaattacggttatttaaaaactaacatttgctatggccaa

SEQ ID NO: 4405 - DNA, 25 bp, Artificial sequence
  Affy probe set ID: 228665_at
aatagggttttctcatcttcaccat

SEQ ID NO: 4406 - DNA, 25 bp, Artificial sequence
  Affy probe set ID: 228665_at
taaacatttattgcgtacctcctat

SEQ ID NO: 4407 - DNA, 25 bp, Artificial sequence
  Affy probe set ID: 228665_at
gcgtacctcctatattctgcaaatt

SEQ ID NO: 4408 - DNA, 25 bp, Artificial sequence
  Affy probe set ID: 228665_at
tccacaccatctcttctttgagttg

SEQ ID NO: 4409 - DNA, 25 bp, Artificial sequence
  Affy probe set ID: 228665_at
ttgagttgtttatggcctcccttaa

SEQ ID NO: 4410 - DNA, 25 bp, Artificial sequence
  Affy probe set ID: 228665_at
atggcctcccttaaggcattttaca

SEQ ID NO: 4411 - DNA, 25 bp, Artificial sequence
  Affy probe set ID: 228665_at
tacaaacccataagcctacaataga

SEQ ID NO: 4412 - DNA, 25 bp, Artificial sequence
  Affy probe set ID: 228665_at
atgtgcacattaccagtatagactg

SEQ ID NO: 4413 - DNA, 25 bp, Artificial sequence
  Affy probe set ID: 228665_at
gactgttggagttcactgattgttt

SEQ ID NO: 4414 - DNA, 25 bp, Artificial sequence
  Affy probe set ID: 228665_at
ttcatagatgatgcttcttggggaa

SEQ ID NO: 4415 - DNA, 25 bp, Artificial sequence
  Affy probe set ID: 228665_at
aaaaactaacatttgctatggccaa

SEQ ID NO: 4416 - DNA, 505 bp, Artificial sequence
  Target_Sequence, Fragment of GenBank Accession No. NM_002837
  misc_feature (41)..(42): n is a, c, g, or t
  misc_feature (51)..(51): n is a, c, g, or t
  misc_feature (89)..(89): n is a, c, g, or t
aaggcttaatgccaacattttcatagaaatgactacaaacnncatatatangtaaatttaaaaacaatagcaaaaacaaaaacagtggncttcagtaaaattttcaaaacttcttttagtaaatcaatgaagtcaaaatgtcaagtaatcacccaaagttgcatttaataacaaaaggcactacatactgtaccaagtttatcttcaatatttgtgccttacttactttgactataacaaattccaatgagtcagaaagtatttccttcatcaaggtccagttccgacagcattcctgggaaaaatttgaaaggagtttgtacggaatcttcatagatacctgagaagatgagctggagatgtttgcctttttcacactacaaatttttctgtaataaacttgggaattagaggtcaagtttgttgatggcatagcttcctttgcataaagagtatatttcttttcaaagtatatatttttgtaacctaccataaagtccgtaag

SEQ ID NO: 4417 - DNA, 25 bp, Artificial sequence
  Affy probe set ID: 230250_at
aaggcttaatgccaacattttcata

SEQ ID NO: 4418 - DNA, 25 bp, Artificial sequence
  Affy probe set ID: 230250_at
tcaagtaatcacccaaagttgcatt

SEQ ID NO: 4419 - DNA, 25 bp, Artificial sequence
  Affy probe set ID: 230250_at
aaggcactacatactgtaccaagtt

SEQ ID NO: 4420 - DNA, 25 bp, Artificial sequence
  Affy probe set ID: 230250_at
tactgtaccaagtttatcttcaata

SEQ ID NO: 4421 - DNA, 25 bp, Artificial sequence
  Affy probe set ID: 230250_at
tcaatatttgtgccttacttacttt

SEQ ID NO: 4422 - DNA, 25 bp, Artificial sequence
  Affy probe set ID: 230250_at
ccttcatcaaggtccagttccgaca

SEQ ID NO: 4423 - DNA, 25 bp, Artificial sequence
  Affy probe set ID: 230250_at
tccagttccgacagcattcctggga

SEQ ID NO: 4424 - DNA, 25 bp, Artificial sequence
  Affy probe set ID: 230250_at
aggagtttgtacggaatcttcatag

SEQ ID NO: 4425 - DNA, 25 bp, Artificial sequence
  Affy probe set ID: 230250_at
gtttgcctttttcacactacaaatt

SEQ ID NO: 4426 - DNA, 25 bp, Artificial sequence
  Affy probe set ID: 230250_at
gatggcatagcttcctttgcataaa

SEQ ID NO: 4427 - DNA, 25 bp, Artificial sequence
  Affy probe set ID: 230250_at
tgtaacctaccataaagtccgtaag

SEQ ID NO: 4428 - DNA, 463 bp, Artificial sequence
  Target_Sequence, Fragment of GenBank Accession No. NM_019558
  misc_feature (214)..(215): n is a, c, g, or t
  misc_feature (434)..(434): n is a, c, g, or t
ggtttctttgcgtattttctaaatgtaatatctcggggaaaatattagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggcaaanngccttgtaaaatgcgtctcattttttaacttgctttcgttttgaaccgcccttgtaatcgcctgaaatcgctagttctttatgcggtggctgccgctgtgttccgttattttcagtaggtgtcatatttatttgtattgcctttgttctgttcgccgctggttttaaaccagcttgctgtgtgcatctcagacgtcggttggtacgtcctccgctgttnttcaggaaagcgatagcctcacctatttg

SEQ ID NO: 4429 - DNA, 25 bp, Artificial sequence
  Affy probe set ID: 231906_at
ggtttctttgcgtattttctaaatg

SEQ ID NO: 4430 - DNA, 25 bp, Artificial sequence
  Affy probe set ID: 231906_at
tgtaacttgtagtccagctctgcag

SEQ ID NO: 4431 - DNA, 25 bp, Artificial sequence
  Affy probe set ID: 231906_at
ctctgcagcttccttaaacttaaga

SEQ ID NO: 4432 - DNA, 25 bp, Artificial sequence
  Affy probe set ID: 231906_at
taaataatctggcaactctggcaaa

SEQ ID NO: 4433 - DNA, 25 bp, Artificial sequence
  Affy probe set ID: 231906_at
cgcccttgtaatcgcctgaaatcgc

SEQ ID NO: 4434 - DNA, 25 bp, Artificial sequence
  Affy probe set ID: 231906_at
aatcgcctgaaatcgctagttcttt

SEQ ID NO: 4435 - DNA, 25 bp, Artificial sequence
  Affy probe set ID: 231906_at
gctagttctttatgcggtggctgcc

SEQ ID NO: 4436 - DNA, 25 bp, Artificial sequence
  Affy probe set ID: 231906_at
ccgctgtgttccgttattttcagta

SEQ ID NO: 4437 - DNA, 25 bp, Artificial sequence
  Affy probe set ID: 231906_at
tctgttcgccgctggttttaaacca

SEQ ID NO: 4438 - DNA, 25 bp, Artificial sequence
  Affy probe set ID: 231906_at
gtgcatctcagacgtcggttggtac

SEQ ID NO: 4439 - DNA, 25 bp, Artificial sequence
  Affy probe set ID: 231906_at
ggaaagcgatagcctcacctatttg

SEQ ID NO: 4440 - DNA, 258 bp, Artificial sequence
  Target_Sequence, Fragment of GenBank Accession No. NM_001442
gtaccattactgaatattaaatccttctttaccatagctacagttaagtaggtgtatctcagaaacctaaggtagttttaaatgtagtgaaattgtccacagcaagctggcccaagtgctcacattttatacccgctctgtcttagtgcgttgcaagagaggagtatatacagtagttcccccttatccacaggggtacattctaagacccccggtgggtgactgaaaccacagatagtaccgaatcttatacatact

SEQ ID NO: 4441 - DNA, 25 bp, Artificial sequence
  Affy probe set ID: 235978_at
gtaccattactgaatattaaatcct

SEQ ID NO: 4442 - DNA, 25 bp, Artificial sequence
  Affy probe set ID: 235978_at
aaatccttctttaccatagctacag

SEQ ID NO: 4443 - DNA, 25 bp, Artificial sequence
  Affy probe set ID: 235978_at
aatgtagtgaaattgtccacagcaa

SEQ ID NO: 4444 - DNA, 25 bp, Artificial sequence
  Affy probe set ID: 235978_at
ctggcccaagtgctcacattttata

SEQ ID NO: 4445 - DNA, 25 bp, Artificial sequence
  Affy probe set ID: 235978_at
caagtgctcacattttatacccgct

SEQ ID NO: 4446 - DNA, 25 bp, Artificial sequence
  Affy probe set ID: 235978_at
tatacccgctctgtcttagtgcgtt

SEQ ID NO: 4447 - DNA, 25 bp, Artificial sequence
  Affy probe set ID: 235978_at
tagtgcgttgcaagagaggagtata

SEQ ID NO: 4448 - DNA, 25 bp, Artificial sequence
  Affy probe set ID: 235978_at
gaggagtatatacagtagttccccc

SEQ ID NO: 4449 - DNA, 25 bp, Artificial sequence
  Affy probe set ID: 235978_at
ccttatccacaggggtacattctaa

SEQ ID NO: 4450 - DNA, 25 bp, Artificial sequence
  Affy probe set ID: 235978_at
tctaagacccccggtgggtgactga

SEQ ID NO: 4451 - DNA, 25 bp, Artificial sequence
  Affy probe set ID: 235978_at
gatagtaccgaatcttatacatact

SEQ ID NO: 4452 - DNA, 224 bp, Artificial sequence
  Target_Sequence, Fragment of GenBank Accession No. NM_024756
aattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggca

SEQ ID NO: 4453 - DNA, 25 bp, Artificial sequence
  Affy probe set ID: 236262_at
aattatccagtcttgggcaattctt

SEQ ID NO: 4454 - DNA, 25 bp, Artificial sequence
  Affy probe set ID: 236262_at
gtcttgggcaattcttgatagcagt

SEQ ID NO: 4455 - DNA, 25 bp, Artificial sequence
  Affy probe set ID: 236262_at
atacacttgtgtttatctgtaattt

SEQ ID NO: 4456 - DNA, 25 bp, Artificial sequence
  Affy probe set ID: 236262_at
ttctccttgccttacatagggtaaa

SEQ ID NO: 4457 - DNA, 25 bp, Artificial sequence
  Affy probe set ID: 236262_at
gaccaagaaatgccaaacgtgaact

SEQ ID NO: 4458 - DNA, 25 bp, Artificial sequence
  Affy probe set ID: 236262_at
taaaatatgtagggccttcaacttt

SEQ ID NO: 4459 - DNA, 25 bp, Artificial sequence
  Affy probe set ID: 236262_at
ttttttacttcctccagtatcttag

SEQ ID NO: 4460 - DNA, 25 bp, Artificial sequence
  Affy probe set ID: 236262_at
cctccagtatcttaggaccatcgta

SEQ ID NO: 4461 - DNA, 25 bp, Artificial sequence
  Affy probe set ID: 236262_at
ggaccatcgtaattcttgttagcat

SEQ ID NO: 4462 - DNA, 25 bp, Artificial sequence
  Affy probe set ID: 236262_at
tcgtaattcttgttagcatctctaa

SEQ ID NO: 4463 - DNA, 25 bp, Artificial sequence
  Affy probe set ID: 236262_at
tgttagcatctctaaccaggaggca

SEQ ID NO: 4464 - DNA, 416 bp, Artificial sequence
  Target_Sequence, Fragment of GenBank Accession No. BQ897248
  misc_feature (41)..(41): n is a, c, g, or t
gaaatatttttgtgttccatggtcaaattattaataaattncaggaaagaaaatctgatgataaatctgatataaataccagaataattattattaatataaaataatattttcacatatgaaggtatgtcttcatactacaggatttctgacttgaatatattctataatgctttaattcattaccataacaaatgtactaagaattaatgttgcatctttagtattccattttttggaactgtttttcaaatgttctatatcctctagcttattatgctatctaaaataatttcagtgtgttttttcctggggcaactgaatgattcttgttttgaatgagtgataaaatgttttgtgatagtatctaatatttggtcctttacagaaaaaatggcttgtggtactatattgaa

SEQ ID NO: 4465 - DNA, 25 bp, Artificial sequence
  Affy probe set ID: 242680_at
gaaatatttttgtgttccatggtca

SEQ ID NO: 4466 - DNA, 25 bp, Artificial sequence
  Affy probe set ID: 242680_at
atgtcttcatactacaggatttctg

SEQ ID NO: 4467 - DNA, 25 bp, Artificial sequence
  Affy probe set ID: 242680_at
aggatttctgacttgaatatattct

SEQ ID NO: 4468 - DNA, 25 bp, Artificial sequence
  Affy probe set ID: 242680_at
gttgcatctttagtattccattttt

SEQ ID NO: 4469 - DNA, 25 bp, Artificial sequence
  Affy probe set ID: 242680_at
gtttttcaaatgttctatatcctct

SEQ ID NO: 4470 - DNA, 25 bp, Artificial sequence
  Affy probe set ID: 242680_at
aatgttctatatcctctagcttatt

SEQ ID NO: 4471 - DNA, 25 bp, Artificial sequence
  Affy probe set ID: 242680_at
atcctctagcttattatgctatcta

SEQ ID NO: 4472 - DNA, 25 bp, Artificial sequence
  Affy probe set ID: 242680_at
cagtgtgttttttcctggggcaact

SEQ ID NO: 4473 - DNA, 25 bp, Artificial sequence
  Affy probe set ID: 242680_at
ggggcaactgaatgattcttgtttt

SEQ ID NO: 4474 - DNA, 25 bp, Artificial sequence
  Affy probe set ID: 242680_at
gtatctaatatttggtcctttacag

SEQ ID NO: 4475 - DNA, 25 bp, Artificial sequence
  Affy probe set ID: 242680_at
aaatggcttgtggtactatattgaa

SEQ ID NO: 4476 - DNA, 238 bp, Artificial sequence
  Target_Sequence, Fragment of GenBank Accession No. NM_020663
aacaacctacatttcaagtactatttcccttctctcccatctaattgctaaagattttctttcatacgcacacactccagtgactggaaaaacgggagttttcagtcaaagcttgacatttagagaaaacaaggactttctgcctttataaatggaaatcaactgtgtatgaactataactctgcagaggttatgaattcatcctttacaaacaataatgaacttttagtcctgtaat

SEQ ID NO: 4477 - DNA, 25 bp, Artificial sequence
  Affy probe set ID: 243481_at
aacaacctacatttcaagtactatt

SEQ ID NO: 4478 - DNA, 25 bp, Artificial sequence
  Affy probe set ID: 243481_at
cttctctcccatctaattgctaaag

SEQ ID NO: 4479 - DNA, 25 bp, Artificial sequence
  Affy probe set ID: 243481_at
gattttctttcatacgcacacactc

SEQ ID NO: 4480 - DNA, 25 bp, Artificial sequence
  Affy probe set ID: 243481_at
atacgcacacactccagtgactgga

SEQ ID NO: 4481 - DNA, 25 bp, Artificial sequence
  Affy probe set ID: 243481_at
aacgggagttttcagtcaaagcttg

SEQ ID NO: 4482 - DNA, 25 bp, Artificial sequence
  Affy probe set ID: 243481_at
gaaaacaaggactttctgcctttat

SEQ ID NO: 4483 - DNA, 25 bp, Artificial sequence
  Affy probe set ID: 243481_at
aggactttctgcctttataaatgga

SEQ ID NO: 4484 - DNA, 25 bp, Artificial sequence
  Affy probe set ID: 243481_at
gtgtatgaactataactctgcagag

SEQ ID NO: 4485 - DNA, 25 bp, Artificial sequence
  Affy probe set ID: 243481_at
actctgcagaggttatgaattcatc

SEQ ID NO: 4486 - DNA, 25 bp, Artificial sequence
  Affy probe set ID: 243481_at
gaattcatcctttacaaacaataat

SEQ ID NO: 4487 - DNA, 25 bp, Artificial sequence
  Affy probe set ID: 243481_at
aataatgaacttttagtcctgtaat

SEQ ID NO: 4488 - DNA, 493 bp, Artificial sequence
  Target_Sequence, Fragment of GenBank Accession No. AK091419
  misc_feature (117)..(117): n is a, c, g, or t
  misc_feature (139)..(139): n is a, c, g, or t
  misc_feature (147)..(147): n is a, c, g, or t
  misc_feature (181)..(181): n is a, c, g, or t
acaggaatgtcaggctaccatcaggtgatggtcaggtggttgttaaactgtctctgtaaaataataattggttgcagccagctccaagcaaggacagtctctcaatagatacaaaanaccctgatctggtgatcagccngcttcccngataagatctcaggagctgggcaagcagcctggnagcatgcgcaccaagaggcaaaatggcggaatttaaccagtatatgacctaccttcctctgggaacgcacgactggtaaggggaaaaatgcctcaagtgagcatgcgcgcaacttcagtaatcacactgtgcatgcgaccccttccaagtgctggcaggtcaccacatacgcggacagcctgctgcaagggaagaatcaggggagatgagacgtaaatcccagaactatgccaaatacataaaaccccaagttaagggtcaggcagggcacttagatctctcaagttgcctgcctgacccaagtgtagtgta

SEQ ID NO: 4489 - DNA, 25 bp, Artificial sequence
  Affy probe set ID: 1558397_at
acaggaatgtcaggctaccatcagg

SEQ ID NO: 4490 - DNA, 25 bp, Artificial sequence
  Affy probe set ID: 1558397_at
agctccaagcaaggacagtctctca

SEQ ID NO: 4491 - DNA, 25 bp, Artificial sequence
  Affy probe set ID: 1558397_at
taaccagtatatgacctaccttcct

SEQ ID NO: 4492 - DNA, 25 bp, Artificial sequence
  Affy probe set ID: 1558397_at
ttcctctgggaacgcacgactggta

SEQ ID NO: 4493 - DNA, 25 bp, Artificial sequence
  Affy probe set ID: 1558397_at
tcaagtgagcatgcgcgcaacttca

SEQ ID NO: 4494 - DNA, 25 bp, Artificial sequence
  Affy probe set ID: 1558397_at
atgcgcgcaacttcagtaatcacac

SEQ ID NO: 4495 - DNA, 25 bp, Artificial sequence
  Affy probe set ID: 1558397_at
gtaatcacactgtgcatgcgacccc

SEQ ID NO: 4496 - DNA, 25 bp, Artificial sequence
  Affy probe set ID: 1558397_at
tggcaggtcaccacatacgcggaca

SEQ ID NO: 4497 - DNA, 25 bp, Artificial sequence
  Affy probe set ID: 1558397_at
gatgagacgtaaatcccagaactat

SEQ ID NO: 4498 - DNA, 25 bp, Artificial sequence
  Affy probe set ID: 1558397_at
caggcagggcacttagatctctcaa

SEQ ID NO: 4499 - DNA, 25 bp, Artificial sequence
  Affy probe set ID: 1558397_at
gcctgcctgacccaagtgtagtgta

SEQ ID NO: 4500 - DNA, 458 bp, Artificial sequence
  Target_Sequence, Fragment of GenBank Accession No. NM_015719
  misc_feature (39)..(39): n is a, c, g, or t
  misc_feature (42)..(43): n is a, c, g, or t
  misc_feature (45)..(45): n is a, c, g, or t
  misc_feature (50)..(50): n is a, c, g, or t
  misc_feature (60)..(60): n is a, c, g, or t
  misc_feature (65)..(65): n is a, c, g, or t
  misc_feature (79)..(79): n is a, c, g, or t
  misc_feature (85)..(86): n is a, c, g, or t
  misc_feature (96)..(96): n is a, c, g, or t
  misc_feature (98)..(98): n is a, c, g, or t
  misc_feature (104)..(104): n is a, c, g, or t
  misc_feature (107)..(107): n is a, c, g, or t
  misc_feature (112)..(112): n is a, c, g, or t
  misc_feature (116)..(116): n is a, c, g, or t
  misc_feature (121)..(121): n is a, c, g, or t
  misc_feature (125)..(126): n is a, c, g, or t
  misc_feature (129)..(139): n is a, c, g, or t
  misc_feature (141)..(146): n is a, c, g, or t
  misc_feature (150)..(150): n is a, c, g, or t
  misc_feature (204)..(204): n is a, c, g, or t
  misc_feature (211)..(211): n is a, c, g, or t
  misc_feature (215)..(215): n is a, c, g, or t
  misc_feature (234)..(234): n is a, c, g, or t
tgcccttcacaccttttggtgctacccctccccagagtnaannantggangtctcctgancccangctgggacccctanccccannccccctttgnancctttnctnacttnccanggtgnaaannacnnnnnnnnnnncnnnnnngggnaagagggacttcccttgactgggttgtgtttcttttcctgcctcagcccagctntgcaaancccntccccctgcccctcacctnccccaggctcaccttgccatgccaggtggtttggggaccaagatgttgggggggtgaatcaggatcctaatggtgctgccctatttatacctgggtctgtattaaaagggaaagtcccccctgttgtagatttcatctgcttcctccttagggaaggctgggatatgatgagagattccagcccaagcccggccccccaccgccaggccatagggcataatttg

SEQ ID NO: 4501 - DNA, 25 bp, Artificial sequence
  Affy probe set ID: 52255_s_at
tgcccttcacaccttttggtgctac

SEQ ID NO: 4502 - DNA, 25 bp, Artificial sequence
  Affy probe set ID: 52255_s_at
gagggacttcccttgactgggttgt

SEQ ID NO: 4503 - DNA, 25 bp, Artificial sequence
  Affy probe set ID: 52255_s_at
ggacttcccttgactgggttgtgtt

SEQ ID NO: 4504 - DNA, 25 bp, Artificial sequence
  Affy probe set ID: 52255_s_at
gctcaccttgccatgccaggtggtt

SEQ ID NO: 4505 - DNA, 25 bp, Artificial sequence
  Affy probe set ID: 52255_s_at
ccatgccaggtggtttggggaccaa

SEQ ID NO: 4506 - DNA, 25 bp, Artificial sequence
  Affy probe set ID: 52255_s_at
ggtgaatcaggatcctaatggtgct

SEQ ID NO: 4507 - DNA, 25 bp, Artificial sequence
  Affy probe set ID: 52255_s_at
gtgaatcaggatcctaatggtgctg

SEQ ID NO: 4508 - DNA, 25 bp, Artificial sequence
  Affy probe set ID: 52255_s_at
tcaggatcctaatggtgctgcccta

SEQ ID NO: 4509 - DNA, 25 bp, Artificial sequence
  Affy probe set ID: 52255_s_at
ggatcctaatggtgctgccctattt

SEQ ID NO: 4510 - DNA, 25 bp, Artificial sequence
  Affy probe set ID: 52255_s_at
cctatttatacctgggtctgtatta

SEQ ID NO: 4511 - DNA, 25 bp, Artificial sequence
  Affy probe set ID: 52255_s_at
ccccctgttgtagatttcatctgct

SEQ ID NO: 4512 - DNA, 25 bp, Artificial sequence
  Affy probe set ID: 52255_s_at
tgttgtagatttcatctgcttcctc

SEQ ID NO: 4513 - DNA, 25 bp, Artificial sequence
  Affy probe set ID: 52255_s_at
tcctccttagggaaggctgggatat

SEQ ID NO: 4514 - DNA, 25 bp, Artificial sequence
  Affy probe set ID: 52255_s_at
cctccttagggaaggctgggatatg

SEQ ID NO: 4515 - DNA, 25 bp, Artificial sequence
  Affy probe set ID: 52255_s_at
gatgagagattccagcccaagcccg

SEQ ID NO: 4516 - DNA, 25 bp, Artificial sequence
  Affy probe set ID: 52255_s_at
ccgccaggccatagggcataatttg

SEQ ID NO: 4517 - DNA, 557 bp, Artificial sequence
  Target_Sequence, Fragment of GenBank Accession No. NM_012072
atccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaatgctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttg

SEQ ID NO: 4518 - DNA, 25 bp, Artificial sequence
  Affy probe set ID: 202878_s_at
atccgaattctccatatattcacta

SEQ ID NO: 4519 - DNA, 25 bp, Artificial sequence
  Affy probe set ID: 202878_s_at
ggtctgttcttgtagataatgccct

SEQ ID NO: 4520 - DNA, 25 bp, Artificial sequence
  Affy probe set ID: 202878_s_at
tggaatccctttattgtgctgttgc

SEQ ID NO: 4521 - DNA, 25 bp, Artificial sequence
  Affy probe set ID: 202878_s_at
gtgctgttgctcttatctgcaaggt

SEQ ID NO: 4522 - DNA, 25 bp, Artificial sequence
  Affy probe set ID: 202878_s_at
tcagcagattttgcccactattcct

SEQ ID NO: 4523 - DNA, 25 bp, Artificial sequence
  Affy probe set ID: 202878_s_at
cccactattcctctgagctgaagtt

SEQ ID NO: 4524 - DNA, 25 bp, Artificial sequence
  Affy probe set ID: 202878_s_at
gcttaagcttgaattagatccctgc

SEQ ID NO: 4525 - DNA, 25 bp, Artificial sequence
  Affy probe set ID: 202878_s_at
gcaaaggcttgctctgtgatgtcag

SEQ ID NO: 4526 - DNA, 25 bp, Artificial sequence
  Affy probe set ID: 202878_s_at
atttaccttcatcctgtgcatgttt

SEQ ID NO: 4527 - DNA, 25 bp, Artificial sequence
  Affy probe set ID: 202878_s_at
gctttgagggtcagcctttaggaag

SEQ ID NO: 4528 - DNA, 25 bp, Artificial sequence
  Affy probe set ID: 202878_s_at
gaaggtgcagctttgttgtcctttg

SEQ ID NO: 4529 - DNA, 513 bp, Artificial sequence
  Target_Sequence, Fragment of GenBank Accession No. NM_000300
gtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaa

SEQ ID NO: 4530 - DNA, 25 bp, Artificial sequence
  Affy probe set ID: 203649_s_at
gtggcgtgggtggcagaggatcccc

SEQ ID NO: 4531 - DNA, 25 bp, Artificial sequence
  Affy probe set ID: 203649_s_at
aaggatgcaacggatcgctgctgtg

SEQ ID NO: 4532 - DNA, 25 bp, Artificial sequence
  Affy probe set ID: 203649_s_at
cgctgctgtgtcactcatgactgtt

SEQ ID NO: 4533 - DNA, 25 bp, Artificial sequence
  Affy probe set ID: 203649_s_at
catgactgttgctacaaacgtctgg

SEQ ID NO: 4534 - DNA, 25 bp, Artificial sequence
  Affy probe set ID: 203649_s_at
gtggcaccaaatttctgagctacaa

SEQ ID NO: 4535 - DNA, 25 bp, Artificial sequence
  Affy probe set ID: 203649_s_at
ctcggggagcagaatcacctgtgca

SEQ ID NO: 4536 - DNA, 25 bp, Artificial sequence
  Affy probe set ID: 203649_s_at
gctgccacctgttttgctagaaaca

SEQ ID NO: 4537 - DNA, 25 bp, Artificial sequence
  Affy probe set ID: 203649_s_at
aaaccttccacccagtgctgaattt

SEQ ID NO: 4538 - DNA, 25 bp, Artificial sequence
  Affy probe set ID: 203649_s_at
taccctaaccaagttccttggccat

SEQ ID NO: 4539 - DNA, 25 bp, Artificial sequence
  Affy probe set ID: 203649_s_at
cagcagatttccagccttctactgc

SEQ ID NO: 4540 - DNA, 25 bp, Artificial sequence
  Affy probe set ID: 203649_s_at
ctcaactccgtgcttaaccaaagaa

SEQ ID NO: 4541 - DNA, 464 bp, Artificial sequence
  Target_Sequence, Fragment of GenBank Accession No. NM_019105
gtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacag

SEQ ID NO: 4542 - DNA, 25 bp, Artificial sequence
  Affy probe set ID: 206093_x_at
gtagactcggctgcggagtactacc

SEQ ID NO: 4543 - DNA, 25 bp, Artificial sequence
  Affy probe set ID: 206093_x_at
actaccgcctccacttggagggcta

SEQ ID NO: 4544 - DNA, 25 bp, Artificial sequence
  Affy probe set ID: 206093_x_at
tcctaccgaggggcctggtggtaca

SEQ ID NO: 4545 - DNA, 25 bp, Artificial sequence
  Affy probe set ID: 206093_x_at
gagctggtaccactggaagggcttc

SEQ ID NO: 4546 - DNA, 25 bp, Artificial sequence
  Affy probe set ID: 206093_x_at
tgagaccaagaaactttcgctcccc

SEQ ID NO: 4547 - DNA, 25 bp, Artificial sequence
  Affy probe set ID: 206093_x_at
cagcggggggaggctgagctgctgc

SEQ ID NO: 4548 - DNA, 25 bp, Artificial sequence
  Affy probe set ID: 206093_x_at
tatgactgccgagcactgaggggtc

SEQ ID NO: 4549 - DNA, 25 bp, Artificial sequence
  Affy probe set ID: 206093_x_at
agagaagagccagggtccttcacca

SEQ ID NO: 4550 - DNA, 25 bp, Artificial sequence
  Affy probe set ID: 206093_x_at
ttcaccacccagccgctggaggaag

SEQ ID NO: 4551 - DNA, 25 bp, Artificial sequence
  Affy probe set ID: 206093_x_at
gctggaggaagccttctctgccagc

SEQ ID NO: 4552 - DNA, 25 bp, Artificial sequence
  Affy probe set ID: 206093_x_at
cgatctcgcagcactgtgtttacag

SEQ ID NO: 4553 - DNA, 143 bp, Artificial sequence
  Target_Sequence, Fragment of GenBank Accession No. NM_030754
tttcgttccttggcgaggcttttgatggggctcgggacatgtggagagcctactctgacatgagagaagccaattacatcggctcagacaaatacttccatgctcgggggaactatgatgctgccaaaaggggacctgggggt

SEQ ID NO: 4554 - DNA, 25 bp, Artificial sequence
  Affy probe set ID: 208607_s_at
tttcgttccttggcgaggcttttga

SEQ ID NO: 4555 - DNA, 25 bp, Artificial sequence
  Affy probe set ID: 208607_s_at
cgttccttggcgaggcttttgatgg

SEQ ID NO: 4556 - DNA, 25 bp, Artificial sequence
  Affy probe set ID: 208607_s_at
ccttggcgaggcttttgatggggct

SEQ ID NO: 4557 - DNA, 25 bp, Artificial sequence
  Affy probe set ID: 208607_s_at
ggcgaggcttttgatggggctcggg

SEQ ID NO: 4558 - DNA, 25 bp, Artificial sequence
  Affy probe set ID: 208607_s_at
gcttttgatggggctcgggacatgt

SEQ ID NO: 4559 - DNA, 25 bp, Artificial sequence
  Affy probe set ID: 208607_s_at
gatggggctcgggacatgtggagag

SEQ ID NO: 4560 - DNA, 25 bp, Artificial sequence
  Affy probe set ID: 208607_s_at
gacatgagagaagccaattacatcg

SEQ ID NO: 4561 - DNA, 25 bp, Artificial sequence
  Affy probe set ID: 208607_s_at
agaagccaattacatcggctcagac

SEQ ID NO: 4562 - DNA, 25 bp, Artificial sequence
  Affy probe set ID: 208607_s_at
ggaactatgatgctgccaaaagggg

SEQ ID NO: 4563 - DNA, 25 bp, Artificial sequence
  Affy probe set ID: 208607_s_at
gatgctgccaaaaggggacctgggg

SEQ ID NO: 4564 - DNA, 25 bp, Artificial sequence
  Affy probe set ID: 208607_s_at
tgctgccaaaaggggacctgggggt

SEQ ID NO: 4565 - DNA, 473 bp, Artificial sequence
  Target_Sequence, Fragment of GenBank Accession No. NM_019105
cccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcaggg

SEQ ID NO: 4566 - DNA, 25 bp, Artificial sequence
  Affy probe set ID: 208609_s_at
cccctgaacgtgttttgcgacatgg

SEQ ID NO: 4567 - DNA, 25 bp, Artificial sequence
  Affy probe set ID: 208609_s_at
gttccagcgccgcatggatggacag

SEQ ID NO: 4568 - DNA, 25 bp, Artificial sequence
  Affy probe set ID: 208609_s_at
gggaggactatgcccatggttttgg

SEQ ID NO: 4569 - DNA, 25 bp, Artificial sequence
  Affy probe set ID: 208609_s_at
catctctggagagttctggctgggc

SEQ ID NO: 4570 - DNA, 25 bp, Artificial sequence
  Affy probe set ID: 208609_s_at
gctgggcaatgaggccctgcacagc

SEQ ID NO: 4571 - DNA, 25 bp, Artificial sequence
  Affy probe set ID: 208609_s_at
tgacacaggcaggtgactactccat

SEQ ID NO: 4572 - DNA, 25 bp, Artificial sequence
  Affy probe set ID: 208609_s_at
gtagactcggctgcggagtactacc

SEQ ID NO: 4573 - DNA, 25 bp, Artificial sequence
  Affy probe set ID: 208609_s_at
actaccgcctccacttggagggcta

SEQ ID NO: 4574 - DNA, 25 bp, Artificial sequence
  Affy probe set ID: 208609_s_at
tcctaccgaggggcctggtggtaca

SEQ ID NO: 4575 - DNA, 25 bp, Artificial sequence
  Affy probe set ID: 208609_s_at
gtggtacaggaactgccactacgcc

SEQ ID NO: 4576 - DNA, 25 bp, Artificial sequence
  Affy probe set ID: 208609_s_at
acgggagcacagtggaccatcaggg

SEQ ID NO: 4577 - DNA, 519 bp, Artificial sequence
  Target_Sequence, Fragment of GenBank Accession No. NM_014220
ttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatg

SEQ ID NO: 4578 - DNA, 25 bp, Artificial sequence
  Affy probe set ID: 209387_s_at
ttggctcttggtggaattgaattca

SEQ ID NO: 4579 - DNA, 25 bp, Artificial sequence
  Affy probe set ID: 209387_s_at
gaattgaattcatcttgtgtcttat

SEQ ID NO: 4580 - DNA, 25 bp, Artificial sequence
  Affy probe set ID: 209387_s_at
attcatcttgtgtcttattcaagta

SEQ ID NO: 4581 - DNA, 25 bp, Artificial sequence
  Affy probe set ID: 209387_s_at
gtaataaatggagtgcttggaggca

SEQ ID NO: 4582 - DNA, 25 bp, Artificial sequence
  Affy probe set ID: 209387_s_at
ggagtgcttggaggcatatgtggct

SEQ ID NO: 4583 - DNA, 25 bp, Artificial sequence
  Affy probe set ID: 209387_s_at
gaggcatatgtggcttttgctgctc

SEQ ID NO: 4584 - DNA, 25 bp, Artificial sequence
  Affy probe set ID: 209387_s_at
cttttgctgctctcaccaacagcaa

SEQ ID NO: 4585 - DNA, 25 bp, Artificial sequence
  Affy probe set ID: 209387_s_at
tccccacagtctacttttacaaacg

SEQ ID NO: 4586 - DNA, 25 bp, Artificial sequence
  Affy probe set ID: 209387_s_at
tttacagactgagtgacagtactca

SEQ ID NO: 4587 - DNA, 25 bp, Artificial sequence
  Affy probe set ID: 209387_s_at
gagtgacagtactcagtatatctga

SEQ ID NO: 4588 - DNA, 25 bp, Artificial sequence
  Affy probe set ID: 209387_s_at
tatatctgagataaactctataatg

SEQ ID NO: 4589 - DNA, 526 bp, Artificial sequence
  Target_Sequence, Fragment of GenBank Accession No. NM_000668
actggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagt

SEQ ID NO: 4590 - DNA, 25 bp, Artificial sequence
  Affy probe set ID: 209612_s_at
actggatgcgttaataacccatgtt

SEQ ID NO: 4591 - DNA, 25 bp, Artificial sequence
  Affy probe set ID: 209612_s_at
ttgaggcaatagagatgccttcccc

SEQ ID NO: 4592 - DNA, 25 bp, Artificial sequence
  Affy probe set ID: 209612_s_at
ccttcttaaccattctactgtgtca

SEQ ID NO: 4593 - DNA, 25 bp, Artificial sequence
  Affy probe set ID: 209612_s_at
ttaaccattctactgtgtcaccttt

SEQ ID NO: 4594 - DNA, 25 bp, Artificial sequence
  Affy probe set ID: 209612_s_at
tctactgtgtcacctttgccattga

SEQ ID NO: 4595 - DNA, 25 bp, Artificial sequence
  Affy probe set ID: 209612_s_at
gtcacctttgccattgaggaaaaat

SEQ ID NO: 4596 - DNA, 25 bp, Artificial sequence
  Affy probe set ID: 209612_s_at
tcttgcatttttggtatcttcataa

SEQ ID NO: 4597 - DNA, 25 bp, Artificial sequence
  Affy probe set ID: 209612_s_at
ggtatcttcataatctttagtcatc

SEQ ID NO: 4598 - DNA, 25 bp, Artificial sequence
  Affy probe set ID: 209612_s_at
tttagtcatcgaatcccagtggagg

SEQ ID NO: 4599 - DNA, 25 bp, Artificial sequence
  Affy probe set ID: 209612_s_at
catgctgggccattgtgattgaagt

SEQ ID NO: 4600 - DNA, 25 bp, Artificial sequence
  Affy probe set ID: 209612_s_at
tgaagtcttctaactctgtctcagt

SEQ ID NO: 4601 - DNA, 555 bp, Artificial sequence
  Target_Sequence, Fragment of GenBank Accession No. NM_000668
gcagatttcttgcttcatatgacaaagcctcaattactaattgtaaaaactgaactattcccagaatcatgttcaaaaaatctgtaatttttgctgatcgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaacacctgtgttaatgctttgttaatgcttttcccactctcatttgttaatgctttcccactctcgggaaggatttgcattttgagctttatctctaaatgtgacatgca

SEQ ID NO: 4602 - DNA, 25 bp, Artificial sequence
  Affy probe set ID: 209613_s_at
gcagatttcttgcttcatatgacaa

SEQ ID NO: 4603 - DNA, 25 bp, Artificial sequence
  Affy probe set ID: 209613_s_at
atgacaaagcctcaattactaattg

SEQ ID NO: 4604 - DNA, 25 bp, Artificial sequence
  Affy probe set ID: 209613_s_at
aactattcccagaatcatgttcaaa

SEQ ID NO: 4605 - DNA, 25 bp, Artificial sequence
  Affy probe set ID: 209613_s_at
gaaagtgcttcattgactaaacagt

SEQ ID NO: 4606 - DNA, 25 bp, Artificial sequence
  Affy probe set ID: 209613_s_at
gaaatggcacaaacaccttaagcaa

SEQ ID NO: 4607 - DNA, 25 bp, Artificial sequence
  Affy probe set ID: 209613_s_at
accttaagcaatatattttcctagt

SEQ ID NO: 4608 - DNA, 25 bp, Artificial sequence
  Affy probe set ID: 209613_s_at
gaacttttctattaactaccatgtc

SEQ ID NO: 4609 - DNA, 25 bp, Artificial sequence
  Affy probe set ID: 209613_s_at
aatgctttgttaatgcttttcccac

SEQ ID NO: 4610 - DNA, 25 bp, Artificial sequence
  Affy probe set ID: 209613_s_at
cttttcccactctcatttgttaatg

SEQ ID NO: 4611 - DNA, 25 bp, Artificial sequence
  Affy probe set ID: 209613_s_at
ggatttgcattttgagctttatctc

SEQ ID NO: 4612 - DNA, 25 bp, Artificial sequence
  Affy probe set ID: 209613_s_at
gctttatctctaaatgtgacatgca

SEQ ID NO: 4613 - DNA, 496 bp, Artificial sequence
  Target_Sequence, Fragment of GenBank Accession No. NM_001354
tctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaa

SEQ ID NO: 4614 - DNA, 25 bp, Artificial sequence
  Affy probe set ID: 209699_x_at
tctggttgcctatagtgctctggga

SEQ ID NO: 4615 - DNA, 25 bp, Artificial sequence
  Affy probe set ID: 209699_x_at
ctaccagctgcagcgtggggttgtg

SEQ ID NO: 4616 - DNA, 25 bp, Artificial sequence
  Affy probe set ID: 209699_x_at
tgtggtcctggccaagagctacaat

SEQ ID NO: 4617 - DNA, 25 bp, Artificial sequence
  Affy probe set ID: 209699_x_at
tgacccttgatatttttgctggccc

SEQ ID NO: 4618 - DNA, 25 bp, Artificial sequence
  Affy probe set ID: 209699_x_at
cccccctaattatccattttctgat

SEQ ID NO: 4619 - DNA, 25 bp, Artificial sequence
  Affy probe set ID: 209699_x_at
gcatgaggtctgccagaaggccctg

SEQ ID NO: 4620 - DNA, 25 bp, Artificial sequence
  Affy probe set ID: 209699_x_at
agaggatggctctatgctggtgact

SEQ ID NO: 4621 - DNA, 25 bp, Artificial sequence
  Affy probe set ID: 209699_x_at
cacatcgcctctggttaaatctctc

SEQ ID NO: 4622 - DNA, 25 bp, Artificial sequence
  Affy probe set ID: 209699_x_at
ctcctgcttggcgacttcagtaagc

SEQ ID NO: 4623 - DNA, 25 bp, Artificial sequence
  Affy probe set ID: 209699_x_at
gtaagctacagctaagcccatcggc

SEQ ID NO: 4624 - DNA, 25 bp, Artificial sequence
  Affy probe set ID: 209699_x_at
gctaagcccatcggccggaaaagaa

SEQ ID NO: 4625 - DNA, 253 bp, Artificial sequence
  Target_Sequence, Fragment of GenBank Accession No. NM_001032281
gccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggtt

SEQ ID NO: 4626 - DNA, 25 bp, Artificial sequence
  Affy probe set ID: 210664_s_at
gccagatttctgctttttggaagaa

SEQ ID NO: 4627 - DNA, 25 bp, Artificial sequence
  Affy probe set ID: 210664_s_at
aagatcctggaatatgtcgaggtta

SEQ ID NO: 4628 - DNA, 25 bp, Artificial sequence
  Affy probe set ID: 210664_s_at
gtcgaggttatattaccaggtattt

SEQ ID NO: 4629 - DNA, 25 bp, Artificial sequence
  Affy probe set ID: 210664_s_at
gaacgtttcaagtatggtggatgcc

SEQ ID NO: 4630 - DNA, 25 bp, Artificial sequence
  Affy probe set ID: 210664_s_at
caagtatggtggatgcctgggcaat

SEQ ID NO: 4631 - DNA, 25 bp, Artificial sequence
  Affy probe set ID: 210664_s_at
gatgcctgggcaatatgaacaattt

SEQ ID NO: 4632 - DNA, 25 bp, Artificial sequence
  Affy probe set ID: 210664_s_at
gagacactggaagaatgcaagaaca

SEQ ID NO: 4633 - DNA, 25 bp, Artificial sequence
  Affy probe set ID: 210664_s_at
gatggtccgaatggtttccaggtgg

SEQ ID NO: 4634 - DNA, 25 bp, Artificial sequence
  Affy probe set ID: 210664_s_at
aattatggaacccagctcaatgctg

SEQ ID NO: 4635 - DNA, 25 bp, Artificial sequence
  Affy probe set ID: 210664_s_at
aatgctgtgaataactccctgactc

SEQ ID NO: 4636 - DNA, 25 bp, Artificial sequence
  Affy probe set ID: 210664_s_at
cctgactccgcaatcaaccaaggtt

SEQ ID NO: 4637 - DNA, 294 bp, Artificial sequence
  Target_Sequence, Fragment of GenBank Accession No. NM_001001924
tgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggca

SEQ ID NO: 4638 - DNA, 25 bp, Artificial sequence
  Affy probe set ID: 212096_s_at
tgggtcatttacatgtacactacat

SEQ ID NO: 4639 - DNA, 25 bp, Artificial sequence
  Affy probe set ID: 212096_s_at
gatactcatgttgcatgttctttta

SEQ ID NO: 4640 - DNA, 25 bp, Artificial sequence
  Affy probe set ID: 212096_s_at
tagtgattttgtgtcttaagtcttt

SEQ ID NO: 4641 - DNA, 25 bp, Artificial sequence
  Affy probe set ID: 212096_s_at
taagtctttaacttccaatacttca

SEQ ID NO: 4642 - DNA, 25 bp, Artificial sequence
  Affy probe set ID: 212096_s_at
gtatgtaaccttccatgtttgcttc

SEQ ID NO: 4643 - DNA, 25 bp, Artificial sequence
  Affy probe set ID: 212096_s_at
ggaaatgtaggttcactgccacttc

SEQ ID NO: 4644 - DNA, 25 bp, Artificial sequence
  Affy probe set ID: 212096_s_at
ggttcactgccacttcatgagatat

SEQ ID NO: 4645 - DNA, 25 bp, Artificial sequence
  Affy probe set ID: 212096_s_at
catgagatatctctgctcacgcttc

SEQ ID NO: 4646 - DNA, 25 bp, Artificial sequence
  Affy probe set ID: 212096_s_at
caaagttgggtttgccattcatccc

SEQ ID NO: 4647 - DNA, 25 bp, Artificial sequence
  Affy probe set ID: 212096_s_at
atggtaaatcttgtgttgttccctg

SEQ ID NO: 4648 - DNA, 25 bp, Artificial sequence
  Affy probe set ID: 212096_s_at
tgtcctccgtattacgtgaccggca

SEQ ID NO: 4649 - DNA, 544 bp, Artificial sequence
  Target_Sequence, Fragment of GenBank Accession No. NM_019105
cacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacag

SEQ ID NO: 4650 - DNA, 25 bp, Artificial sequence
  Affy probe set ID: 213451_x_at
cacaggcaggtgactactccatgcg

SEQ ID NO: 4651 - DNA, 25 bp, Artificial sequence
  Affy probe set ID: 213451_x_at
gtagactcggctgcggagtactacc

SEQ ID NO: 4652 - DNA, 25 bp, Artificial sequence
  Affy probe set ID: 213451_x_at
actaccgcctccacttggagggcta

SEQ ID NO: 4653 - DNA, 25 bp, Artificial sequence
  Affy probe set ID: 213451_x_at
tcctaccgaggggcctggtggtaca

SEQ ID NO: 4654 - DNA, 25 bp, Artificial sequence
  Affy probe set ID: 213451_x_at
gagctggtaccactggaagggcttc

SEQ ID NO: 4655 - DNA, 25 bp, Artificial sequence
  Affy probe set ID: 213451_x_at
tgagaccaagaaactttcgctcccc

SEQ ID NO: 4656 - DNA, 25 bp, Artificial sequence
  Affy probe set ID: 213451_x_at
tatgactgccgagcactgaggggtc

SEQ ID NO: 4657 - DNA, 25 bp, Artificial sequence
  Affy probe set ID: 213451_x_at
agagaagagccagggtccttcacca

SEQ ID NO: 4658 - DNA, 25 bp, Artificial sequence
  Affy probe set ID: 213451_x_at
ttcaccacccagccgctggaggaag

SEQ ID NO: 4659 - DNA, 25 bp, Artificial sequence
  Affy probe set ID: 213451_x_at
gctggaggaagccttctctgccagc

SEQ ID NO: 4660 - DNA, 25 bp, Artificial sequence
  Affy probe set ID: 213451_x_at
cgatctcgcagcactgtgtttacag

SEQ ID NO: 4661 - DNA, 426 bp, Artificial sequence
  Target_Sequence, Fragment of GenBank Accession No. NM_004449
ctcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaa

SEQ ID NO: 4662 - DNA, 25 bp, Artificial sequence
  Affy probe set ID: 213541_s_at
ctcgagggttcatgcagtcagtgtt

SEQ ID NO: 4663 - DNA, 25 bp, Artificial sequence
  Affy probe set ID: 213541_s_at
gtcagtgttataccaaacccagtgt

SEQ ID NO: 4664 - DNA, 25 bp, Artificial sequence
  Affy probe set ID: 213541_s_at
aaaaatgcgcatctctttctttgtt

SEQ ID NO: 4665 - DNA, 25 bp, Artificial sequence
  Affy probe set ID: 213541_s_at
ttcaggacctcatcattatgtgggg

SEQ ID NO: 4666 - DNA, 25 bp, Artificial sequence
  Affy probe set ID: 213541_s_at
caggtaagagatggccttcttggct

SEQ ID NO: 4667 - DNA, 25 bp, Artificial sequence
  Affy probe set ID: 213541_s_at
ggctgccacaatcagaaatcacgca

SEQ ID NO: 4668 - DNA, 25 bp, Artificial sequence
  Affy probe set ID: 213541_s_at
gcattttgggtaggcggcctccagt

SEQ ID NO: 4669 - DNA, 25 bp, Artificial sequence
  Affy probe set ID: 213541_s_at
ccagttttcctttgagtcgcgaacg

SEQ ID NO: 4670 - DNA, 25 bp, Artificial sequence
  Affy probe set ID: 213541_s_at
gtcgcgaacgctgtgcgtttgtcag

SEQ ID NO: 4671 - DNA, 25 bp, Artificial sequence
  Affy probe set ID: 213541_s_at
actacgagttgatctcggccagcca

SEQ ID NO: 4672 - DNA, 25 bp, Artificial sequence
  Affy probe set ID: 213541_s_at
tcggccagccaaagacacacgacaa

SEQ ID NO: 4673 - DNA, 239 bp, Artificial sequence
  Target_Sequence, Fragment of GenBank Accession No. NM_018407
atatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaa

SEQ ID NO: 4674 - DNA, 25 bp, Artificial sequence
  Affy probe set ID: 214039_s_at
atatttgatatacttctgcctaaca

SEQ ID NO: 4675 - DNA, 25 bp, Artificial sequence
  Affy probe set ID: 214039_s_at
tatacttctgcctaacaacatggaa

SEQ ID NO: 4676 - DNA, 25 bp, Artificial sequence
  Affy probe set ID: 214039_s_at
catcctactgctttgaacttccaag

SEQ ID NO: 4677 - DNA, 25 bp, Artificial sequence
  Affy probe set ID: 214039_s_at
gaacttccaagtatgtctagtcacc

SEQ ID NO: 4678 - DNA, 25 bp, Artificial sequence
  Affy probe set ID: 214039_s_at
ccaagtatgtctagtcaccttttaa

SEQ ID NO: 4679 - DNA, 25 bp, Artificial sequence
  Affy probe set ID: 214039_s_at
gaaaaatgaggattgccttccttgt

SEQ ID NO: 4680 - DNA, 25 bp, Artificial sequence
  Affy probe set ID: 214039_s_at
tccttgtatgcgctttttaccttga

SEQ ID NO: 4681 - DNA, 25 bp, Artificial sequence
  Affy probe set ID: 214039_s_at
tttttaccttgactacctgaattgc

SEQ ID NO: 4682 - DNA, 25 bp, Artificial sequence
  Affy probe set ID: 214039_s_at
gactacctgaattgcaagggatttt

SEQ ID NO: 4683 - DNA, 25 bp, Artificial sequence
  Affy probe set ID: 214039_s_at
gttacaaagtcagcaactctcctgt

SEQ ID NO: 4684 - DNA, 25 bp, Artificial sequence
  Affy probe set ID: 214039_s_at
actctcctgttggttcattattgaa

SEQ ID NO: 4685 - DNA, 547 bp, Artificial sequence
  Target_Sequence, Fragment of GenBank Accession No. NM_000331
  misc_feature (163)..(163): n is a, c, g, or t
  misc_feature (170)..(170): n is a, c, g, or t
  misc_feature (178)..(178): n is a, c, g, or t
  misc_feature (186)..(186): n is a, c, g, or t
  misc_feature (210)..(210): n is a, c, g, or t
  misc_feature (213)..(215): n is a, c, g, or t
  misc_feature (258)..(258): n is a, c, g, or t
  misc_feature (420)..(420): n is a, c, g, or t
  misc_feature (437)..(441): n is a, c, g, or t
  misc_feature (454)..(456): n is a, c, g, or t
  misc_feature (458)..(458): n is a, c, g, or t
tcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgnctgggcngcagaagngatcagcnatgccagagagaatatccagagantcnnnggccatggtgcggaggactcgctggccgatcaggctgccaatnaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaantacttaagaggtggaannnnnaaaaaaaaaaaannnanggggggcccggtcccaattcgccctataggagtcgattacaatcacctgccgtcgttacacgtctgactggaaaacctgcgtacccact

SEQ ID NO: 4686 - DNA, 25 bp, Artificial sequence
  Affy probe set ID: 214456_x_at
tcagcagccgaagcttcttttcgtt

SEQ ID NO: 4687 - DNA, 25 bp, Artificial sequence
  Affy probe set ID: 214456_x_at
tttcgttccttggcgaggcttttga

SEQ ID NO: 4688 - DNA, 25 bp, Artificial sequence
  Affy probe set ID: 214456_x_at
ggctcagacaaatacttccatgctc

SEQ ID NO: 4689 - DNA, 25 bp, Artificial sequence
  Affy probe set ID: 214456_x_at
gctcgggggaactatgatgctgcca

SEQ ID NO: 4690 - DNA, 25 bp, Artificial sequence
  Affy probe set ID: 214456_x_at
gccatggtgcggaggactcgctggc

SEQ ID NO: 4691 - DNA, 25 bp, Artificial sequence
  Affy probe set ID: 214456_x_at
acctgctggcctgcctgagaaatac

SEQ ID NO: 4692 - DNA, 25 bp, Artificial sequence
  Affy probe set ID: 214456_x_at
agaaatactgagcttcctcttcact

SEQ ID NO: 4693 - DNA, 25 bp, Artificial sequence
  Affy probe set ID: 214456_x_at
caggagatctggctgtgaggccctc

SEQ ID NO: 4694 - DNA, 25 bp, Artificial sequence
  Affy probe set ID: 214456_x_at
ggagtcgattacaatcacctgccgt

SEQ ID NO: 4695 - DNA, 25 bp, Artificial sequence
  Affy probe set ID: 214456_x_at
cgtcgttacacgtctgactggaaaa

SEQ ID NO: 4696 - DNA, 25 bp, Artificial sequence
  Affy probe set ID: 214456_x_at
tgactggaaaacctgcgtacccact

SEQ ID NO: 4697 - DNA, 546 bp, Artificial sequence
  Target_Sequence, Fragment of GenBank Accession No. NM_019105
gacacaggcaggtgactactccatccgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacag

SEQ ID NO: 4698 - DNA, 25 bp, Artificial sequence
  Affy probe set ID: 216333_x_at
gacacaggcaggtgactactccatc

SEQ ID NO: 4699 - DNA, 25 bp, Artificial sequence
  Affy probe set ID: 216333_x_at
gtagactcggctgcggagtactacc

SEQ ID NO: 4700 - DNA, 25 bp, Artificial sequence
  Affy probe set ID: 216333_x_at
actaccgcctccacttggagggcta

SEQ ID NO: 4701 - DNA, 25 bp, Artificial sequence
  Affy probe set ID: 216333_x_at
tcctaccgaggggcctggtggtaca

SEQ ID NO: 4702 - DNA, 25 bp, Artificial sequence
  Affy probe set ID: 216333_x_at
gagctggtaccactggaagggcttc

SEQ ID NO: 4703 - DNA, 25 bp, Artificial sequence
  Affy probe set ID: 216333_x_at
tgagaccaagaaactttcgctcccc

SEQ ID NO: 4704 - DNA, 25 bp, Artificial sequence
  Affy probe set ID: 216333_x_at
tatgactgccgagcactgaggggtc

SEQ ID NO: 4705 - DNA, 25 bp, Artificial sequence
  Affy probe set ID: 216333_x_at
agagaagagccagggtccttcacca

SEQ ID NO: 4706 - DNA, 25 bp, Artificial sequence
  Affy probe set ID: 216333_x_at
ttcaccacccagccgctggaggaag

SEQ ID NO: 4707 - DNA, 25 bp, Artificial sequence
  Affy probe set ID: 216333_x_at
gctggaggaagccttctctgccagc

SEQ ID NO: 4708 - DNA, 25 bp, Artificial sequence
  Affy probe set ID: 216333_x_at
cgatctcgcagcactgtgtttacag

SEQ ID NO: 4709 - DNA, 520 bp, Artificial sequence
  Target_Sequence, Fragment of GenBank Accession No. NM_001034954
aactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatat

SEQ ID NO: 4710 - DNA, 25 bp, Artificial sequence
  Affy probe set ID: 218087_s_at
aactttgtatagcccatgtacctac

SEQ ID NO: 4711 - DNA, 25 bp, Artificial sequence
  Affy probe set ID: 218087_s_at
gcccatgtacctaccttgtatagaa

SEQ ID NO: 4712 - DNA, 25 bp, Artificial sequence
  Affy probe set ID: 218087_s_at
ggaattccaaataactcacctacag

SEQ ID NO: 4713 - DNA, 25 bp, Artificial sequence
  Affy probe set ID: 218087_s_at
aactcacctacagatttttagcaca

SEQ ID NO: 4714 - DNA, 25 bp, Artificial sequence
  Affy probe set ID: 218087_s_at
gaggaaaggtaactctgatctcagt

SEQ ID NO: 4715 - DNA, 25 bp, Artificial sequence
  Affy probe set ID: 218087_s_at
agtcctatttatctgcagtcgtatt

SEQ ID NO: 4716 - DNA, 25 bp, Artificial sequence
  Affy probe set ID: 218087_s_at
atctgcagtcgtattaagtcctatt

SEQ ID NO: 4717 - DNA, 25 bp, Artificial sequence
  Affy probe set ID: 218087_s_at
attgccatttaaattacacactgag

SEQ ID NO: 4718 - DNA, 25 bp, Artificial sequence
  Affy probe set ID: 218087_s_at
cacactgagagcatgtcctatgcag

SEQ ID NO: 4719 - DNA, 25 bp, Artificial sequence
  Affy probe set ID: 218087_s_at
gcagacatagatttttctgttcatt

SEQ ID NO: 4720 - DNA, 25 bp, Artificial sequence
  Affy probe set ID: 218087_s_at
gaattactacatttgctgtacatat

SEQ ID NO: 4721 - DNA, 517 bp, Artificial sequence
  Target_Sequence, Fragment of GenBank Accession No. NM_017734
catagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttatttttttcttaagtccaaaaattatcattacagtgtaccatattaagccatgtgaataagtagtagtcattatttgtgaaaaattcccaaaagctggggaaaacaatgtgtaacttttccagttacttgacacgattcagtgggggaaaaccagcattttttattctattgata

SEQ ID NO: 4722 - DNA, 25 bp, Artificial sequence
  Affy probe set ID: 218736_s_at
catagctccccatagtcaggtgtac

SEQ ID NO: 4723 - DNA, 25 bp, Artificial sequence
  Affy probe set ID: 218736_s_at
catagtcaggtgtaccagccagcca

SEQ ID NO: 4724 - DNA, 25 bp, Artificial sequence
  Affy probe set ID: 218736_s_at
gaagctagtcctcatgaaaacacaa

SEQ ID NO: 4725 - DNA, 25 bp, Artificial sequence
  Affy probe set ID: 218736_s_at
aagaaagcttaggcagccctgtcca

SEQ ID NO: 4726 - DNA, 25 bp, Artificial sequence
  Affy probe set ID: 218736_s_at
cattccccatttgatgctcagacaa

SEQ ID NO: 4727 - DNA, 25 bp, Artificial sequence
  Affy probe set ID: 218736_s_at
gacaactggagatgggactgaggat

SEQ ID NO: 4728 - DNA, 25 bp, Artificial sequence
  Affy probe set ID: 218736_s_at
gaggatccatccttaacagctttaa

SEQ ID NO: 4729 - DNA, 25 bp, Artificial sequence
  Affy probe set ID: 218736_s_at
gatctaagagttgtaccacctatat

SEQ ID NO: 4730 - DNA, 25 bp, Artificial sequence
  Affy probe set ID: 218736_s_at
acagtgtaccatattaagccatgtg

SEQ ID NO: 4731 - DNA, 25 bp, Artificial sequence
  Affy probe set ID: 218736_s_at
tttccagttacttgacacgattcag

SEQ ID NO: 4732 - DNA, 25 bp, Artificial sequence
  Affy probe set ID: 218736_s_at
accagcattttttattctattgata

SEQ ID NO: 4733 - DNA, 372 bp, Artificial sequence
  Target_Sequence, Fragment of GenBank Accession No. NM_024756
gaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcatt

SEQ ID NO: 4734 - DNA, 25 bp, Artificial sequence
  Affy probe set ID: 219091_s_at
gaaagacattcttccccaggaggaa

SEQ ID NO: 4735 - DNA, 25 bp, Artificial sequence
  Affy probe set ID: 219091_s_at
atggaggcaacattttggccaacat

SEQ ID NO: 4736 - DNA, 25 bp, Artificial sequence
  Affy probe set ID: 219091_s_at
aaagcactagagggcaatgggatta

SEQ ID NO: 4737 - DNA, 25 bp, Artificial sequence
  Affy probe set ID: 219091_s_at
gattaaaccaacctgcttggtctct

SEQ ID NO: 4738 - DNA, 25 bp, Artificial sequence
  Affy probe set ID: 219091_s_at
gcttggtctctattagtcagtaatg

SEQ ID NO: 4739 - DNA, 25 bp, Artificial sequence
  Affy probe set ID: 219091_s_at
cagtaatgaagacgacagcctggcc

SEQ ID NO: 4740 - DNA, 25 bp, Artificial sequence
  Affy probe set ID: 219091_s_at
gtatctttagtttcagtcattcctt

SEQ ID NO: 4741 - DNA, 25 bp, Artificial sequence
  Affy probe set ID: 219091_s_at
tagtttcagtcattccttgtaggat

SEQ ID NO: 4742 - DNA, 25 bp, Artificial sequence
  Affy probe set ID: 219091_s_at
attgtaatccctataatccccacat

SEQ ID NO: 4743 - DNA, 25 bp, Artificial sequence
  Affy probe set ID: 219091_s_at
gaggtaattggatcttgggggcggt

SEQ ID NO: 4744 - DNA, 25 bp, Artificial sequence
  Affy probe set ID: 219091_s_at
tttgatagttcctcctgtgttcatt

SEQ ID NO: 4745 - DNA, 424 bp, Artificial sequence
  Target_Sequence, Fragment of GenBank Accession No. NM_006744
actgggacgtgtgcgcagacatggtgggcaccttcacagacaccgaggaccctgccaagttcaagatgaagtactggggcgtagcctcctttctgcagaaaggaaatgatgaccactggatcgtcgacacagactacgacacgtatgccgtacagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatctt

SEQ ID NO: 4746 - DNA, 25 bp, Artificial sequence
  Affy probe set ID: 219140_s_at
actgggacgtgtgcgcagacatggt

SEQ ID NO: 4747 - DNA, 25 bp, Artificial sequence
  Affy probe set ID: 219140_s_at
gacatggtgggcaccttcacagaca

SEQ ID NO: 4748 - DNA, 25 bp, Artificial sequence
  Affy probe set ID: 219140_s_at
gaccactggatcgtcgacacagact

SEQ ID NO: 4749 - DNA, 25 bp, Artificial sequence
  Affy probe set ID: 219140_s_at
gacacagactacgacacgtatgccg

SEQ ID NO: 4750 - DNA, 25 bp, Artificial sequence
  Affy probe set ID: 219140_s_at
gcccccagaagcgcagaagattgta

SEQ ID NO: 4751 - DNA, 25 bp, Artificial sequence
  Affy probe set ID: 219140_s_at
gaagattgtaaggcagcggcaggag

SEQ ID NO: 4752 - DNA, 25 bp, Artificial sequence
  Affy probe set ID: 219140_s_at
gccaggcagtacaggctgatcgtcc

SEQ ID NO: 4753 - DNA, 25 bp, Artificial sequence
  Affy probe set ID: 219140_s_at
tgatcgtccacaacggttactgcga

SEQ ID NO: 4754 - DNA, 25 bp, Artificial sequence
  Affy probe set ID: 219140_s_at
gaatctagtttcatctgagaacttc

SEQ ID NO: 4755 - DNA, 25 bp, Artificial sequence
  Affy probe set ID: 219140_s_at
aacttctgattagctctcagtcttc

SEQ ID NO: 4756 - DNA, 25 bp, Artificial sequence
  Affy probe set ID: 219140_s_at
ctcagtcttcagctctatttatctt

SEQ ID NO: 4757 - DNA, 577 bp, Artificial sequence
  Target_Sequence, Fragment of GenBank Accession No. NM_001034954
tgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataa

SEQ ID NO: 4758 - DNA, 25 bp, Artificial sequence
  Affy probe set ID: 222513_s_at
tgccactaattcattcacactaagg

SEQ ID NO: 4759 - DNA, 25 bp, Artificial sequence
  Affy probe set ID: 222513_s_at
taggaatgagttacctcttcccaca

SEQ ID NO: 4760 - DNA, 25 bp, Artificial sequence
  Affy probe set ID: 222513_s_at
gacagagcagggccttaatcccaag

SEQ ID NO: 4761 - DNA, 25 bp, Artificial sequence
  Affy probe set ID: 222513_s_at
tgttgttgttttacggtctctgagg

SEQ ID NO: 4762 - DNA, 25 bp, Artificial sequence
  Affy probe set ID: 222513_s_at
gcacggcagcatttcaccgattgtg

SEQ ID NO: 4763 - DNA, 25 bp, Artificial sequence
  Affy probe set ID: 222513_s_at
atgtgtttcctggtctttagatgca

SEQ ID NO: 4764 - DNA, 25 bp, Artificial sequence
  Affy probe set ID: 222513_s_at
caggggtgcttcttgattagtaggg

SEQ ID NO: 4765 - DNA, 25 bp, Artificial sequence
  Affy probe set ID: 222513_s_at
tttgcatatgatgccagcctcacgc

SEQ ID NO: 4766 - DNA, 25 bp, Artificial sequence
  Affy probe set ID: 222513_s_at
gcctcacgcatttgtatatctccag

SEQ ID NO: 4767 - DNA, 25 bp, Artificial sequence
  Affy probe set ID: 222513_s_at
gaaattcaggtatgcctcaccaatt

SEQ ID NO: 4768 - DNA, 25 bp, Artificial sequence
  Affy probe set ID: 222513_s_at
tcaccaatttgcccgtctttaataa

The invention claimed is:

1. A method of treating a subject suffering from diffuse large B cell lymphoma (DLBCL), the method comprising:
    (1) predicting the survival outcome of the subject comprising:
        a) obtaining one or more DLBCL biopsy samples from a subject;
        b) isolating gene expression product from the one or more DLBCL biopsy samples;
        c) obtaining a gene expression profile from the gene expression product by detecting an expression level for each gene in a germinal center B cell (GCB) gene expression signature and a stromal-1 gene expression signature and a stromal-2 gene expression signature;
        d) determining a GCB signature value and a stromal-1 signature value and a stromal-2 gene signature value from the gene expression profile, and
        e) calculating a survival predictor score using the equation: survival predictor score=8.11−[0.419*(the GCB signature value)]−[1.015*(the stromal-1 signature value)]+[0.675*(the stromal-2 signature value)],
    wherein a lower survival predictor score indicates a more favorable survival outcome and a higher survival predictor score indicates a less favorable survival outcome for the subject; and
    (2) treating the subject with chemotherapy and Rituximab.

2. The method of claim 1, wherein the GCB signature value corresponds to the average of the expression levels of the genes in the GCB gene expression signature, the stromal-1 signature value corresponds to the average of the expression levels of the genes in the stromal-1 gene expression signature, and the stromal-2 signature value corresponds to the average of the expression levels of the genes in the stromal-2 gene expression signature.

3. The method of claim 1, wherein the one or more DLBCL samples are obtained from a subject designated for treatment with chemotherapy and Rituximab.

4. The method of claim 1, further comprising: (1)
f) tracking a survival outcome for the subject following treatment for DLBCL; and
g) generating a survival estimate curve that correlates the probability of the tracked survival outcome with time following treatment for DLBCL, wherein the survival curve also correlates tracked outcome over time with the survival predictor score for the subject.

5. The method of claim 4, wherein the survival outcome is overall survival.

6. The method of claim 4, wherein the survival outcome is progression free survival.

7. The method of claim 4, wherein the GCB signature value corresponds to the average of the expression levels of the genes in the GCB gene expression signature, the stromal-1 signature value corresponds to the average of the expression levels of the genes in the stromal-1 gene expression signature, and the stromal-2 signature value corresponds to the average of the expression levels of the genes in the stromal-2 gene expression signature.

8. The method of claim 1, further comprising: (1)
f) calculating the probability of a survival outcome for the subject beyond an amount of time t following treatment for DLBCL, wherein the subject's probability of the survival outcome P(SO) is calculated using the equation: P(SO)=SO0(t)(exp((s)*survival predictor score)), wherein SO0(t) is the probability of the survival outcome, which corresponds to the largest time value smaller than t in a survival outcome curve, and wherein (s) is a scale factor.

9. The method of claim 1, further comprising: (1)
f) calculating the probability of overall survival after time t for the subject, wherein the subject's probability of overall survival P(OS) is calculated using the equation: P(OS)=OS0(t)(exp(survival predictor score)), wherein OS0(t) is the probability of overall survival, which corresponds to the largest time value smaller than t in an overall survival curve.

10. The method of claim 1, further comprising: (1)
f) calculating the probability of progression free survival after time t for the subject, wherein the subject's probability of progression free survival P(PFS) is calculated using the equation P(PFS)=F0(t)(exp(0.976*survival predictor score)), wherein F0(t) is the probability of progression free survival, which corresponds to the largest time smaller than t in a survival curve.

11. The method of claim 8, wherein the GCB signature value corresponds to the average of the expression levels of the genes in the GCB gene expression signature, the stromal-1 signature value corresponds to the average of the expression levels of the genes in the stromal-1 gene expression signature, and the stromal-2 signature value corresponds to the average of the expression levels of the genes in the stromal-2 gene expression signature.

12. The method of claim 8, wherein the method further includes providing the subject with the calculated probability of the survival outcome after time t.

13. A method of treating a subject suffering from diffuse large B cell lymphoma (DLBCL), the method comprising:
(1) selecting the subject for antiangiogenic therapy of DLBCL comprising:
a) isolating gene expression product from one or more DLBCL biopsy samples from a subject;
b) obtaining a gene expression profile from the gene expression product by detecting an expression level for each gene in a stromal-1 signature and a stromal-2 signature;
c) determining the subject's stromal-1 signature value and stromal-2 signature value from the gene expression profile;
d) subtracting the stromal-1 signature value from the stromal-2 signature value to thereby obtain the subject's stromal score;
e) determining whether the subject's stromal score is higher or lower than a standard stromal score; wherein antiangiogenic therapy is indicated by a stromal score that is higher than a standard stromal score and antiangiogenic therapy is not indicated by a stromal score that is not higher than a standard stromal score; and
f) determining that the subject's stromal score that is higher than the standard stromal score; and
(2) treating the subject with antiangiogenic therapy.

14. The method of claim 13, wherein the stromal-1 signature value corresponds to the average of the expression levels of the genes in the stromal-1 gene expression signature and the stromal-2 signature value corresponds to the average of the expression levels of the genes in the stromal-2 gene expression signature.

15. The method of claim 9, wherein the GCB signature value corresponds to the average of the expression levels of the genes in the GCB gene expression signature, the stromal-1 signature value corresponds to the average of the expression levels of the genes in the stromal-1 gene expression signature, and the stromal-2 signature value corresponds to the average of the expression levels of the genes in the stromal-2 gene expression signature.

16. The method of claim 10, wherein the GCB signature value corresponds to the average of the expression levels of the genes in the GCB gene expression signature, the stromal-1 signature value corresponds to the average of the expression levels of the genes in the stromal-1 gene expression signature, and the stromal-2 signature value corresponds to the average of the expression levels of the genes in the stromal-2 gene expression signature.

* * * * *